US008110674B2

(12) United States Patent
Manoharan et al.

(10) Patent No.: US 8,110,674 B2
(45) Date of Patent: Feb. 7, 2012

(54) THERAPEUTIC COMPOSITIONS

(75) Inventors: Muthiah Manoharan, Weston, MA (US); David Bumcrot, Belmont, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 8 days.

(21) Appl. No.: 10/548,611

(22) PCT Filed: Mar. 8, 2004

(86) PCT No.: PCT/US2004/007070
§ 371 (c)(1),
(2), (4) Date: Aug. 22, 2006

(87) PCT Pub. No.: WO2004/080406
PCT Pub. Date: Sep. 23, 2004

(65) Prior Publication Data
US 2007/0275914 A1 Nov. 29, 2007

Related U.S. Application Data

(60) Provisional application No. 60/452,682, filed on Mar. 7, 2003, provisional application No. 60/454,265, filed on Mar. 12, 2003, provisional application No. 60/454,962, filed on Mar. 13, 2003, provisional application No. 60/455,050, filed on Mar. 13, 2003, provisional application No. 60/462,894, filed on Apr. 14, 2003, provisional application No. 60/463,772, filed on Apr. 17, 2003, provisional application No. 60/465,665, filed on Apr. 25, 2003, provisional application No. 60/465,802, filed on Apr. 25, 2003, provisional application No. 60/469,612, filed on May 9, 2003, provisional application No. 60/493,986, filed on Aug. 8, 2003, provisional application No. 60/494,597, filed on Aug. 11, 2003, provisional application No. 60/506,341, filed on Sep. 26, 2003, provisional application No. 60/510,246, filed on Oct. 9, 2003, provisional application No. 60/510,318, filed on Oct. 10, 2003, provisional application No. 60/518,453, filed on Nov. 7, 2003.

(51) Int. Cl.
*C07H 21/04* (2006.01)
*A61K 31/70* (2006.01)
(52) U.S. Cl. .................................. 536/24.5; 514/44
(58) Field of Classification Search .................. None
See application file for complete search history.

(56) References Cited

U.S. PATENT DOCUMENTS

| 4,897,355 | A | 1/1990 | Eppstein et al. |
| 5,171,678 | A | 12/1992 | Behr et al. |
| 5,283,185 | A | 2/1994 | Epand et al. |
| 5,691,316 | A | 11/1997 | Agrawal et al. |
| 6,066,500 | A | 5/2000 | Bennett et al. |
| 6,509,323 | B1 | 1/2003 | Davis et al. |
| 2002/0037555 | A1* | 3/2002 | Chen .............................. 435/325 |
| 2003/0008818 | A1 | 1/2003 | Pun et al. |
| 2003/0087853 | A1* | 5/2003 | Crooke et al. ..................... 435/6 |
| 2003/0143732 | A1* | 7/2003 | Fosnaugh et al. ............. 435/325 |
| 2004/0002077 | A1* | 1/2004 | Taira et al. .......................... 435/6 |
| 2004/0198640 | A1* | 10/2004 | Leake et al. ....................... 514/8 |

FOREIGN PATENT DOCUMENTS

| WO | WO 91/16024 | 10/1991 |
| WO | WO 93/24640 | 12/1993 |
| WO | WO 94/00569 | 1/1994 |
| WO | WO 96/37194 | 11/1996 |
| WO | WO 98/39359 | 9/1998 |
| WO | WO 00/44895 | 8/2000 |
| WO | WO 00/44914 | 8/2000 |
| WO | WO 01/36646 | 5/2001 |
| WO | WO 01/75164 | 10/2001 |
| WO | WO 02/44321 | 6/2002 |
| WO | WO 03/011887 | 2/2003 |
| WO | WO 03/012052 | 2/2003 |
| WO | WO 03/064621 A2 | 8/2003 |
| WO | 2004/090105 A2 | 10/2004 |
| WO | 2005/001043 A2 | 1/2005 |
| WO | 2005/097817 A2 | 10/2005 |

OTHER PUBLICATIONS

Bass, Nature 2001 vol. 411, pp. 428-429.*
Amarzguioui et al. Nucleic Acids Research 2003, vol. 31, pp. 589-595.*
Chiu et al. RNA 2003, vol. 9, pp. 1034-1048.*
Amosova et al., "Effect of the 1-(2'-deoxy-β-D-ribofuranosyl)-3-nitropyrrole residue on the stability of DNA duplexes and triplexes" *Nucleic Acids Res.* 25:1930-1934 (1997).
Aoki et al., "Potential tumor-targeting peptide vector of histidylated oligolysine conjugated to a tumor-homing RGD motif" *Cancer Gene Ther.* 8:783-787 (2001).
Ausin et al., "Synthesis of Amino- and Guanidino-G-Clamp PNA Monomers" *Org. Lett.* 4:4073-4075 (2002).
Berger et al., "Universal bases for hybridization, replication and chain termination" *Nucleic Acids Res.* 28:2911-2914 (2000).
Bergstrom et al., "Synthesis, Structure, and Deoxyribonucleic Acid Sequencing with a Universal Nucleoside: 1-(2'-Deoxy-β-D-ribofuranosyl)-3-nitropyrrole" *J. Am. Chem. Soc.* 117:1201-1209 (1995).
Brotschi et al., "A Stable DNA Duplex Containing a Non-Hydrogen-Bonding and Non-Shape-Complementary Base Couple: Interstrand Stacking as the Stability Determining Factor" *Angew. Chem. Int. Ed. Engl.* 40:3012-3014 (2001). Chaloin et al., "Design of Carrier Peptide-Oligonucleotide Conjugates with Rapid Membrane Translocation and Nuclear Localization Properties" *Biochem. Biophys. Res. Commun.* 243:601-608 (1998).
Chen et al., "Determination of stereochemistry stability coefficients of amino acid side-chains in an amphipathic α-helix" *J. Pept. Res.* 59:18-33 (2002).
Colledge et al., "Disruption of c-*mos* causes parthenogenetic development of unfertilized mouse eggs" *Nature* 370:65-68 (1994).
Cornut et al., "The amphipathic α-helix concept. Application to the de novo design of ideally amphipathic Leu, Lys peptides with hemolytic activity higher than that of melittin" *FEBS Lett.* 349:29-33 (1994).

(Continued)

Primary Examiner — Tracy Vivlemore
(74) *Attorney, Agent, or Firm* — Jeffrey N. Townes; LeClairRyan

(57) ABSTRACT

Therapeutic sRNA agents and methods of making and using are enclosed.

39 Claims, 10 Drawing Sheets

OTHER PUBLICATIONS

Derossi et al., "The Third Helix of the Antennapedia Homeodomain Translocates through Biological Membranes" *J. Biol. Chem.* 269:10444-10450 (1994).

Elbashir et al., "Functional anatomy of siRNAs for mediating efficient RNAi in *Drosophila melanogaster* embryo lysate" *EMBO J.* 20:6877-6888 (2001).

Elmquist et al., "VE-Cadherin-Derived Cell-Penetrating Peptide, pVEC, with Carrier Functions" *Exp. Cell Res.* 269:237-244 (2001).

Felgner et al., "Enhanced Gene Delivery and Mechanism Studies with a Novel Series of Cationic Lipid Formulations" *J. Biol. Chem.* 269:2550-2561 (1994).

Felgner et al., "Lipofection: A highly efficient, lipid-mediated DNA-transfection procedure" *Proc. Natl. Acad. Sci. USA* 84:7413-7417 (1987).

Fire et al., "Potent and specific genetic interference by double-stranded RNA in *Caenorhabditis elegans*" *Nature* 391:806-811 (1998).

Flanagan et al., "A cytosine analog that confers enhanced potency to antisense oligonucleotides" *Proc. Natl. Acad. Sci. USA* 96:3513-3518 (1999).

Gante, "Azapeptides" *Synthesis* pp. 405-413 (1989).

Gao et al., "A Novel Cationic Liposome Reagent for Efficient Transfection of Mammalian Cells" *Biochem. Biophys. Res. Commun.* 179:280-285 (1991).

GenBank Accession No. AF009605, "Mus musculus phosphoenolpyruvate carboxykinase (PEPCK) gene, complete cds" Feb. 25, 2000.

GenBank Accession No. BC013448, "Mus musculus glucose-6-phosphatase, catalytic, mRNA (cDNA clone MGC:18472 Image:4237115), complete cds" Jun. 29, 2004.

GenBank Accession No. NM_008061, "Mus musculus glucose-6-phosphatase, catalytic (G6pc), mRNA" Apr. 16, 2005.

GenBank Accession No. NM_011044, "Mus musculus phosphoenolpyruvate carboxykinase 1, cytosolic (Pck1), mRNA" Jul. 4, 2005.

GenBank Accession No. U00445, "Mus musculus glucose-6-phosphatase mRNA, complete cds" Nov. 24, 1993.

Gershon et al., "Mode of Formation and Structural Features of DNA—Cationic Liposome Complexes Used for Transfection" *Biochemistry* 32:7143-7151 (1993).

Grell et al., "Protein Design and Folding: Template Trapping of Self-assembled Helical Bundles" *J. Pept. Sci.* 7:146-151 (2001).

Guckian et al., "Structure and Base Pairing Properties of a Replicable Nonpolar Isostere for Deoxyadenosine" *J. Org. Chem.* 63:9652-9656 (1998).

Hammond et al., "Argonaute2, a Link Between Genetic and Biochemical Analyses of RNAi" *Science* 293:1146-1150 (2001).

Hammond et al., "Post-Transcriptional Gene Silencing by Double-Stranded RNA" *Nat. Rev. Genet.* 2:110-119 (2001).

Hashimoto et al., "Parthenogenetic activation of oocytes in c-*mos*-deficient mice" *Nature* 370:68-71 (1994).

Haubner et al., "Glycosylated RGD-Containing Peptides: Tracer for Tumor Targeting and Angiogenesis Imaging with Improved Biokinetics" *J. Nucl. Med.* 42:326-336 (2001).

Holmes et al., "Steric inhibition of human immunodeficiency virus type-1 Tat-dependent *trans*-activation in vitro and in cells by oligonucleotides containing 2'-O-methyl G-clamp ribonucleoside analogues" *Nucleic Acids Res.* 31:2759-2768 (2003).

Holmes et al., "The Synthesis of 2'-O-Methyl G-Clamp Containing Oligonucleotides and Their Inhibition of the HIV-1 Tat-TAR Interaction" *Nucleosides Nucleotides Nucleic Acids* 22:1259-1262 (2003).

Iwata et al., "Design and Synthesis of Amphipathic $3_{10}$-Helical Peptides and Their Interactions with Phospholipid Bilayers and Ion Channel Formation" *J. Biol. Chem.* 269:4928-4933 (1994).

Kawasaki et al., "Uniformly Modified 2'-Deoxy-2'-fluoro Phosphorothioate Oligonucleotides as Nuclease-Resistant Antisense Compounds with High Affinity and Specificity for RNA Targets" *J. Med. Chem.* 36:831-841 (1993).

Ketting et al., "Dicer functions in RNA interference and in synthesis of small RNA involved in developmental timing in *C. elegans*" *Genes Dev.* 15:2654-2659 (2001).

Lam et al., "A new type of synthetic peptide library for identifying ligand-binding activity" *Nature* 354:82-84 (1991).

Lan et al., "Minor Groove Hydration Is Critical to the Stability of DNA Duplexes" *J. Am. Chem. Soc.* 122:6512-6513 (2000).

Limbach et al., "Summary: the modified nucleosides of RNA" *Nucleic Acids Res.* 22:2183-2196 (1994).

Liu et al., "Bi-stranded, multisite replication of a base pair between difluorotoluene and adenine: confirmation by 'inverse' sequencing" *Chem. Biol.* 4:919-926 (1997).

Maier et al., "Nuclease Resistance of Oligonucleotides Containing the Tricyclic Cytosine Analogues Phenoxazine and 9-(2-Aminoethoxy)-Phenoxazine ("G-clamp") and Origins of Their Nuclease Resistance Properties" *Biochemistry* 41:1323-1327 (2002).

Manoharan, "Oligonucleotide Conjugates as Potential Antisense Drugs with Improved Uptake, Biodistribution, Targeted Delivery, and Mechanism of Action" *Antisense Nucleic Acid Drug Dev.* 12:103-128 (2002).

Martin, "Stereoselective Synthesis of 2'-O-(2-Methoxyethyl)ribonucleosides: Neighboring-Group Participation of the Methoxyethoxy Group in the Ribosylation Step" *Helv. Chim. Acta* 79:1930-1938 (1996) (English abstract included).

Matray et al., "Selective and Stable DNA Base Pairing without Hydrogen Bonds" *J. Am. Chem. Soc.* 120:6191-6192 (1998).

McMinn et al., "Efforts toward Expansion of the Genetic Alphabet: DNA Polymerase Recognition of a Highly Stable, Self-Pairing Hydrophobic Base" *J. Am. Chem. Soc.* 121:11585-11586 (1999).

Mitchell et al., "Polyarginine enters cells more efficiently than other polycationic homopolymers" *J. Pept. Res.* 56:318-325 (2000).

Morales et al., "Importance of Terminal Base Pair Hydrogen-Bonding in 3'-End Proofreading by the Klenow Fragment of DNA Polymerase I" *Biochemistry* 39:2626-2632 (2000).

Moran et al., "Difluorotoluene, a Nonpolar Isostere for Thymine, Codes Specifically and Efficiently for Adenine in DNA Replication" *J. Am. Chem. Soc.* 119:2056-2057 (1997).

Nabel et al., "Direct gene transfer with DNA-liposome complexes in melanoma: Expression, biologic activity, and lack of toxicity in humans" *Proc. Natl. Acad. Sci. USA* 90:11307-11311 (1993).

Nabel et al., "Gene Transfer In Vivo with DNA-Liposome Complexes: Lack of Autoimmunity and Gonadal Localization" *Hum. Gene Ther.* 3:649-656 (1992).

Nakashima et al., "ApoE-Deficient Mice Develop Lesions of All Phases of Atherosclerosis Throughout the Arterial Tree" *Arterioscler. Thromb.* 14:133-140 (1994).

Nakatani et al., "Recognition of a Single Guanine Bulge by 2-Acylamino-1,8-naphthyridine" *J. Am. Chem. Soc.* 122:2172-2177 (2000).

Nakatani et al., "Specific Binding of 2-Amino-1,8-naphthyridine into a Single Guanine Bulge as Evidenced by Photooxidation of GG Doublet" *Bioorg. Med. Chem. Lett.* 11:335-337 (2001).

Negrete et al., "Deciphering the structural code for proteins: Helical Propensities in domain classes and statistical multiresidue information in α-helices" *Protein Sci.* 7:1368-1379 (1998).

Oehlke et al., "Cellular uptake of an α-helical amphipathic model peptide with the potential to deliver polar compounds into the cell interior non-endocytically" *Biochim. Biophys. Acta* 1414:127-139 (1998).

Ogawa et al., "Efforts toward the Expansion of the Genetic Alphabet: Information Storage and Replication with Unnatural Hydrophobic Base Pairs" *J. Am. Chem. Soc.* 122:3274-3287 (2000).

Ogawa et al., "Rational Design of an Unnatural Base Pair with Increased Kinetic Selectivity" *J. Am. Chem. Soc.* 122:8803-8804 (2000).

Oliver et al., "Effect of the Universal Base 3-Nitropyrrole on the Selectivity of Neighboring Natural Bases" *Org. Lett.* 3:1977-1980 (2001).

Parrish et al., "Functional Anatomy of a dsRNA Trigger: Differential Requirement for the Two Trigger Strands in RNA Interference" *Mol. Cell* 6:1077-1087 (2000).

Pirrung et al., "A Universal, Photocleavable DNA Base: Nitropiperonyl 2'-Deoxyriboside" *J. Org. Chem.* 66:2067-2071 (2001).

Plump et al., "Severe Hypercholesterolemia and Atherosclerosis in Apolipoprotein E-Deficient Mice Created by Homologous Recombination in ES Cells" *Cell* 71:343-353 (1992).

Pooga et al., "Cell penetration by transportan" *FASEB J.* 12:67-77 (1998).

Rajeev et al., "High-Affinity Peptide Nucleic Acid Oligomers Containing Tricyclic Cytosine Analogues" *Org. Lett.* 4:4395-4398 (2002).

Reddick et al., "Atherosclerosis in Mice Lacking Apo E. Evaluation of Lesional Development and Progression" *Arterioscler. Thromb.* 14:141-147 (1994).

Simeoni et al., "Insight into the mechanism of the peptide-based gene delivery system MPG: implications for delivery of siRNA into mammalian cells" *Nucleic Acids Res.* 31:2717-2724 (2003).

Strauss et al., "Molecular complementation of a collagen mutation in mammalian cells using yeast artificial chromosomes" *EMBO J.* 11:417-422 (1992).

Tae et al., "Efforts toward Expansion of the Genetic Alphabet: Replication of DNA with Three Base Pairs" *J. Am. Chem. Soc.* 123:7439-7440 (2001).

Vivès et al., "A Truncated HIV-1 Tat Protein Basic Domain Rapidly Translocates through the Plasma Membrane and Accumulates in the Cell Nucleus" *J. Biol. Chem.* 272:16010-16017 (1997).

Weizman et al., "2,2'-Bipyridine Ligandoside: A Novel Building Block for Modifying DNA with Intra-Duplex Metal Complexes" *J. Am. Chem. Soc.* 123:3375-3376 (2001).

Wengel, "Synthesis of 3'-C- and 4'-C-Branched Oligodeoxynucleotides and the Development of Locked Nucleic Acid (LNA)" *Acc. Chem. Res.* 32:301-310 (1999).

Wilds et al., "Structural Basis for Recognition of Guanosine by a Synthetic Tricyclic Cytosine Analogue: Guanidinium G-Clamp" *Helv. Chim. Acta* 86:966-978 (2003).

Wu et al., "Efforts toward Expansion of the Genetic Alphabet: Optimization of Interbase Hydrophobic Interactions" *J. Am. Chem. Soc.* 122:7621-7632 (2000).

Xu et al., "A Novel Human Apolipoprotein (apoM)" *J. Biol. Chem.* 274:31286-31290 (1999).

Zhang et al., "Spontaneous Hypercholesterolemia and Arterial Lesions in Mice Lacking Apolipoprotein E" *Science* 258:468-471 (1992).

Zhou et al., "Lipophilic polylysines mediate efficient DNA transfection in mammalian cells" *Biochim. Biophys. Acta* 1065:8-14 (1991).

Zhou et al., "Targeted delivery of DNA by liposomes and polymers" *J. Control. Release* 19:269-274 (1992).

Zimmerman et al., "Model Studies Directed toward a General Triplex DNA Recognition Scheme: A Novel DNA Base That Binds a CG Base-Pair in an Organic Solvent" *J. Am. Chem. Soc.* 117:10769-10770 (1995).

Zitzmann et al., "Arginine-Glycine-Aspartic Acid (RGD)-Peptide Binds to Both Tumor and Tumor-Endothelial Cells in Vivo" *Cancer Res.* 62:5139-5143 (2002).

Braasch Dwaine A et al., "RNA Interference in Mammalian Cells by Chemically-Modified RNA" Biochemistry, vol. 42, Jul. 8, 2003, pp. 7967-7975.

Harborth Jens et al., "Sequence, Chemical, and Structural Variation of Small Interfering RNAs and Short Hairpin RNAs and the Effect on Mammalian Gene Silicensing", Antisense & Nucleic Acid Drug Development, vol. 13, No. 2, Apr. 2003, pp. 83-105.

Czauderna Frank et al., "Structural Variations and Stabilising Modifications of Synthetic siRNAs in Mammalian Cells" Nucleic Acids Research, vol. 31, No. 11, Jun. 1, 2003, pp. 2705-2716.

European Communication dated Oct. 20, 2008 from European Application No. 04718537.6.

Amarzguioui, M., et al.: "Tolerance for Mutations and Chemical Modifications in a siRNA", Nucleic Acid Research, vol. 31(2), pp. 589-595, 2003.

Amarzguioui, et al. "Tolerance for Mutations and Chemical Modifications in a siRNA", Nucleic Acids Research, vol. 31, No. 2, Jan. 15, 2003, pp. 589-595.

Schwarz, et al., "Asymmetry in the Assembly of the RNAi Enzyme Complex", Cell, vol. 115, Oct. 17, 2003, pp. 199-208.

Martinez et al., "Synthetic Small Inhibiting RNAs: Efficient Tools to Inactivate Oncongenic Mutations and Restore p53 Pathways," *PNAS*, 99:14849-14854 (2002).

Monga et al., "Beta-Catenin Antisense Studies in Embryonic Liver Cultures: Role in Proliferation, Apoptosis, and Lineage Specification," *Gastroenterology*, 124:202-216 (2003).

Scherr et al., "Specific Inhibition of BCR-ABL Gene Expression by Small Interfering RNA," *Blood*, 101:1566-1569 (2003).

\* cited by examiner

THERAPEUTIC COMPOSITIONS

RELATED APPLICATIONS

The present application is the National Stage of International Application No. PCT/US2004/007070, filed Mar. 8, 2004, which claims the benefit of Application No. 60/452,682, filed Mar. 7, 2003; Application No. 60/462,894, filed Apr. 14, 2003; and Application No. 60/465,665, filed Apr. 25, 2003; Application No. 60/463,772, filed Apr. 17, 2003; Application No. 60/465,802, filed Apr. 25, 2003; Application No. 60/493,986, filed Aug. 8, 2003; Application No. 60/494,597, filed Aug. 11, 2003; Application No. 60/506,341, filed Sep. 26, 2003; Application No. 60/518,453, filed Nov. 7, 2003; Application No. 60/454,265, filed Mar. 12, 2003; Application No. 60/454,962, filed Mar. 13, 2003; Application No. 60/455,050, filed Mar. 13, 2003; Application No. 60/469,612, filed May 9, 2003; Application No. 60/510,246, filed Oct. 9, 2003; Application No. 60/510,318, filed Oct. 10, 2003. The contents of the above applications are hereby incorporated by reference in their entirety.

TECHNICAL FIELD

The invention relates to RNAi and related methods, e.g., methods of making and using iRNA agents.

BACKGROUND

RNA interference or "RNAi" is a term initially coined by Fire and co-workers to describe the observation that double-stranded RNA (dsRNA) can block gene expression when it is introduced into worms (Fire et al. (1998) *Nature* 391, 806-811). Short dsRNA directs gene-specific, post-transcriptional silencing in many organisms, including vertebrates, and has provided a new tool for studying gene function. RNAi may involve mRNA degradation.

SUMMARY

A number of advances related to the application of RNAi to the treatment of subjects are disclosed herein. For example, the invention features iRNA agents targeted to specific genes; palindromic iRNA agents; iRNA agents having non canonical monomer pairings; iRNA agents having particular structures or architectures e.g., the Z-X-Y or asymmetrical iRNA agents described herein; drug delivery conjugates for the delivery of iRNA agents; amphipathic substances for the delivery of iRNA agents, as well as iRNA agents having chemical modifications for optimizing a property of the iRNA agent. The invention features each of these advances broadly as well as in combinations. For example, an iRNA agent targeted to a specific gene can also include one or more of a palindrome, non canonical, Z-X-Y, or asymmetric structure. Other nonlimiting examples of combinations include an asymmetric structure combined with a chemical modification, or formulations or methods or routes of delivery combined with, e.g., chemical modifications or architectures described herein. The iRNA agents of the invention can include any one of these advances, or pairwise or higher order combinations of the separate advances.

In one aspect, the invention features iRNA agents that can target more than one RNA region, and methods of using and making the iRNA agents.

In another aspect, an iRNA agent includes a first and second sequence that are sufficiently complementary to each other to hybridize. The first sequence can be complementary to a first target RNA region and the second sequence can be complementary to a second target RNA region.

In one embodiment, the first and second sequences of the iRNA agent are on different RNA strands, and the mismatch between the first and second sequences is less than 50%, 40%, 30%, 20%, 10%, 5%, or 1%.

In another embodiment, the first and second sequences of the iRNA agent are on the same RNA strand, and in a related embodiment more than 50%, 60%, 70%, 80%, 90%, 95%, or 1% of the iRNA agent is in bimolecular form.

In another embodiment, the first and second sequences of the iRNA agent are fully complementary to each other.

In one embodiment, the first target RNA region is encoded by a first gene and the second target RNA region is encoded by a second gene, and in another embodiment, the first and second target RNA regions are different regions of an RNA from a single gene. In another embodiment, the first and second sequences differ by at least 1 and no more than 6 nucleotides.

In certain embodiments, the first and second target RNA regions are on transcripts encoded by first and second sequence variants, e.g., first and second alleles, of a gene. The sequence variants can be mutations, or polymorphisms, for example.

In certain embodiments, the first target RNA region includes a nucleotide substitution, insertion, or deletion relative to the second target RNA region.

In other embodiments, the second target RNA region is a mutant or variant of the first target RNA region.

In certain embodiments, the first and second target RNA regions comprise viral, e.g., HCV, or human RNA regions. The first and second target RNA regions can also be on variant transcripts of an oncogene or include different mutations of a tumor suppressor gene transcript. In one embodiment, the oncogene, or tumor suppressor gene is expressed in the liver. In addition, the first and second target RNA regions correspond to hot-spots for genetic variation.

In another aspect, the invention features a mixture of varied iRNA agent molecules, including one iRNA agent that includes a first sequence and a second sequence sufficiently complementary to each other to hybridize, and where the first sequence is complementary to a first target RNA region and the second sequence is complementary to a second target RNA region. The mixture also includes at least one additional iRNA agent variety that includes a third sequence and a fourth sequence sufficiently complementary to each other to hybridize, and where the third sequence is complementary to a third target RNA region and the fourth sequence is complementary to a fourth target RNA region. In addition, the first or second sequence is sufficiently complementary to the third or fourth sequence to be capable of hybridizing to each other. In one embodiment, at least one, two, three or all four of the target RNA regions are expressed in the liver. Exemplary RNAs are transcribed from the apoB-100 gene, glucose-6-phosphatase gene, beta catenin gene, or an HCV gene.

In certain embodiments, the first and second sequences are on the same or different RNA strands, and the third and fourth sequences are on same or different RNA strands.

In one embodiment, the mixture further includes a third iRNA agent that is composed of the first or second sequence and the third or fourth sequence.

In one embodiment, the first sequence is identical to at least one of the second, third and fourth sequences, and in another embodiment, the first region differs by at least 1 but no more than 6 nucleotides from at least one of the second, third and fourth regions.

In certain embodiments, the first target RNA region comprises a nucleotide substitution, insertion, or deletion relative to the second, third or fourth target RNA region.

The target RNA regions can be variant sequences of a viral or human RNA, and in certain embodiments, at least two of the target RNA regions can be on variant transcripts of an oncogene or tumor suppressor gene. In one embodiment, the oncogene or tumor suppressor gene is expressed in the liver.

In certain embodiments, at least two of the target RNA regions correspond to hot-spots for genetic variation.

In one embodiment, the iRNA agents of the invention are formulated for pharmaceutical use. In one aspect, the invention provides a container (e.g., a vial, syringe, nebulizer, etc) to hold the iRNA agents described herein.

Another aspect of the invention features a method of making an iRNA agent. The method includes constructing an iRNA agent that has a first sequence complementary to a first target RNA region, and a second sequence complementary to a second target RNA region. The first and second target RNA regions have been identified as being sufficiently complementary to each other to be capable of hybridizing. In one embodiment, the first and second target RNA regions are on transcripts expressed in the liver.

In certain embodiments, the first and second target RNA regions can correspond to two different regions encoded by one gene, or to regions encoded by two different genes.

Another aspect of the invention features a method of making an iRNA agent composition. The method includes obtaining or providing information about a region of an RNA of a target gene (e.g., a viral or human gene, or an oncogene or tumor suppressor, e.g., p53), where the region has high variability or mutational frequency (e.g., in humans). In addition, information about a plurality of RNA targets within the region is obtained or provided, where each RNA target corresponds to a different variant or mutant of the gene (e.g., a region including the codon encoding p53 248Q and/or p53 249S). The iRNA agent is constructed such that a first sequence is complementary to a first of the plurality of variant RNA targets (e.g., encoding 249Q) and a second sequence is complementary to a second of the plurality of variant RNA targets (e.g., encoding 249S). The first and second sequences are sufficiently complementary to hybridize. In certain embodiments, the target gene can be a viral or human gene expressed in the liver.

In one embodiment, sequence analysis, e.g., to identify common mutants in the target gene, is used to identify a region of the target gene that has high variability or mutational frequency. For example, sequence analysis can be used to identify regions of apoB-100 or beta catenin that have high variability or mutational frequency. In another embodiment, the region of the target gene having high variability or mutational frequency is identified by obtaining or providing genotype information about the target gene from a population. In another embodiment, the genotype information can be from a population suffering from a liver disorder, such as hepatocellular carcinoma or hepatoblastoma.

Another aspect of the invention features a method of modulating expression, e.g., downregulating or silencing, a target gene, by providing an iRNA agent that has a first sequence and a second sequence sufficiently complementary to each other to hybridize. In addition, the first sequence is complementary to a first target RNA region and the second sequence is complementary to a second target RNA region.

In one embodiment, the iRNA agent is administered to a subject, e.g., a human.

In another embodiment, the first and second sequences are between 15 and 30 nucleotides in length.

In one embodiment, the method of modulating expression of the target gene further includes providing a second iRNA agent that has a third sequence complementary to a third target RNA region. The third sequence can be sufficiently complementary to the first or second sequence to be capable of hybridizing to either the first or second sequence.

Another aspect of the invention features a method of modulating expression, e.g., downregulating or silencing, a plurality of target RNAs, each of the plurality of target RNAs corresponding to a different target gene. The method includes providing an iRNA agent selected by identifying a first region in a first target RNA of the plurality and a second region in a second target RNA of the plurality, where the first and second regions are sufficiently complementary to each other to be capable of hybridizing.

In another aspect of the invention, an iRNA agent molecule includes a first sequence complementary to a first variant RNA target region and a second sequence complementary to a second variant RNA target region, and the first and second variant RNA target regions correspond to first and second variants or mutants of a target gene. In certain embodiments, the target gene is an apoB-100, beta catenin, or glucose-6 phosphatase gene.

In one embodiment, the target gene is a viral gene (e.g., an HCV gene), tumor suppressor or oncogene.

In another embodiment, the first and second variant target RNA regions include allelic variants of the target gene.

In another embodiment, the first and second variant RNA target regions comprise mutations (e.g., point mutations) or polymorphisms of the target gene.

In one embodiment, the first and second variant RNA target regions correspond to hot-spots for genetic variation.

Another aspect of the invention features a plurality (e.g., a panel or bank) of iRNA agents. Each of the iRNA agents of the plurality includes a first sequence complementary to a first variant target RNA region and a second sequence complementary to a second variant target RNA region, where the first and second variant target RNA regions correspond to first and second variants of a target gene. In certain embodiments, the variants are allelic variants of the target gene.

Another aspect of the invention provides a method of identifying an iRNA agent for treating a subject. The method includes providing or obtaining information, e.g., a genotype, about a target gene, providing or obtaining information about a plurality (e.g., panel or bank) of iRNA agents, comparing the information about the target gene to information about the plurality of iRNA agents, and selecting one or more of the plurality of iRNA agents for treating the subject. Each of the plurality of iRNA agents includes a first sequence complementary to a first variant target RNA region and a second sequence complementary to a second variant target RNA region, and the first and second variant target RNA regions correspond to first and second variants of the target gene. The target gene can be an endogenous gene of the subject or a viral gene. The information about the plurality of iRNA agents can be the sequence of the first or second sequence of one or more of the plurality.

In certain embodiments, at least one of the selected iRNA agents includes a sequence capable of hybridizing to an RNA region corresponding to the target gene, and at least one of the selected iRNA agents comprises a sequence capable of hybridizing to an RNA region corresponding to a variant or mutant of the target gene.

In one aspect, the invention relates to compositions and methods for silencing genes expressed in the liver, e.g., to treat disorders of or related to the liver. An iRNA agent composition of the invention can be one which has been modified to alter distribution in favor of the liver.

In another aspect, the invention relates to iRNA agents that can target more than one RNA region, and methods of using and making the iRNA agents. In one embodiment, the RNA is from a gene that is active in the liver, e.g., apoB-100, glucose-6-phosphatase, beta-catenin, or Hepatitis C virus (HCV).

In another aspect, an iRNA agent includes a first and second sequence that are sufficiently complementary to each other to hybridize. The first sequence can be complementary to a first target RNA region and the second sequence can be complementary to a second target RNA region. For example, the first sequence can be complementary to a first target apoB-100 RNA region and the second sequence can be complementary to a second target apoB-100 RNA region.

In one embodiment, the first target RNA region is encoded by a first gene, e.g., a gene expressed in the liver, and the second target RNA region is encoded by a second gene, e.g., a second gene expressed in the liver. In another embodiment, the first and second target RNA regions are different regions of an RNA from a single gene, e.g., a single gene that is at least expressed in the liver. In another embodiment, the first and second sequences differ by at least one and no more than six nucleotides.

In another embodiment, sequence analysis, e.g., to identify common mutants in the target gene, is used to identify a region of the target gene that has high variability or mutational frequency. For example, sequence analysis can be used to identify regions of aopB-100 or beta catenin that have high variability or mutational frequency. In another embodiment, the region of the target gene having high variability or mutational frequency is identified by obtaining or providing genotype information about the target gene from a population. In particular, the genotype information can be from a population suffering from a liver disorder, such as hepatocellular carcinoma or hepatoblastoma.

In another aspect, the invention features a method for reducing apoB-100 levels in a subject, e.g., a mammal, such as a human. The method includes administering to a subject an iRNA agent which targets apoB-100. The iRNA agent can be one described here, and can be a dsRNA that has a sequence that is substantially identical to a sequence of the apoB-100 gene. The iRNA can be less than 30 nucleotides in length, e.g., 21-23 nucleotides. Preferably, the iRNA is 21 nucleotides in length. In one embodiment, the iRNA is 21 nucleotides in length, and the duplex region of the iRNA is 19 nucleotides. In another embodiment, the iRNA is greater than 30 nucleotides in length.

In a preferred embodiment, the subject is treated with an iRNA agent which targets one of the sequences listed in Tables 5 and 6. In a preferred embodiment it targets both sequences of a palindromic pair provided in Tables 5 and 6. The most preferred targets are listed in descending order of preferrability, in other words, the more preferred targets are listed earlier in Tables 5 and 6.

In a preferred embodiment the iRNA agent will include regions, or strands, which are complementary to a pair in Tables 5 and 6. In a preferred embodiment the iRNA agent will include regions complementary to the palindromic pairs of Tables 5 and 6 as a duplex region.

In a preferred embodiment the duplex region of the iRNA agent will target a sequence listed in Tables 5 and 6 but will not be perfectly complementary with the target sequence, e.g., it will not be complementary at least 1 base pair. Preferably, it will have no more than 1, 2, 3, 4, or 5 bases, in total, or per strand, which do not hybridize with the target sequence In a preferred embodiment the iRNA agent includes overhangs, e.g., 3' or 5' overhangs, preferably one or more 3' overhangs. Overhangs are discussed in detail elsewhere herein but are preferably about 2 nucleotides in length. The overhangs can be complementary to the gene sequences being targeted or can be other sequence. TT is a preferred overhang sequence. The first and second iRNA agent sequences can also be joined, e.g., by additional bases to form a hairpin, or by other non-base linkers.

The iRNA agent that targets apoB-100 can be administered in an amount sufficient to reduce expression of apoB-100 mRNA. In one embodiment, the iRNA agent is administered in an amount sufficient to reduce expression of apoB-100 protein (e.g., by at least 2%, 4%, 6%, 10%, 15%, 20%). Preferably, the iRNA agent does not reduce expression of apoB-48 mRNA or protein. This can be effected, e.g., by selection of an iRNA agent which specifically targets the nucleotides subject to RNA editing in the apoB-100 transcript.

The iRNA agent that targets apoB-100 can be administered to a subject, wherein the subject is suffering from a disorder characterized by elevated or otherwise unwanted expression of apoB-100, elevated or otherwise unwanted levels of cholesterol, and/or disregulation of lipid metabolism. The iRNA agent can be administered to an individual at risk for the disorder to delay onset of the disorder or a symptom of the disorder. These disorders include HDL/LDL cholesterol imbalance; dyslipidemias, e.g., familial combined hyperlipidemia (FCHL), acquired hyperlipidemia; hypercholesterolemia; statin-resistant hypercholesterolemia; coronary artery disease (CAD) coronary heart disease (CHD) atherosclerosis. In one embodiment, the iRNA that targets apoB-100 is administered to a subject suffering from statin-resistant hypercholesterolemia.

The apoB-100 iRNA agent can be administered in an amount sufficient to reduce levels of serum LDL-C and/or HDL-C and/or total cholesterol in a subject. For example, the iRNA is administered in an amount sufficient to decrease total cholesterol by at least 0.5%, 1%, 2.5%, 5%, 10% in the subject. In one embodiment, the iRNA agent is administered in an amount sufficient to reduce the risk of myocardial infarction the subject.

In a preferred embodiment the iRNA agent is administered repeatedly. Administration of an iRNA agent can be carried out over a range of time periods. It can be administered daily, once every few days, weekly, or monthly. The timing of administration can vary from patient to patient, depending on such factors as the severity of a patient's symptoms. For example, an effective dose of an iRNA agent can be administered to a patient once a month for an indefinite period of time, or until the patient no longer requires therapy. In addition, sustained release compositions containing an iRNA agent can be used to maintain a relatively constant dosage in the patient's blood.

In one embodiment, the iRNA agent can be targeted to the liver, and apoB expression level are decreased in the liver following administration of the apoB iRNA agent. For example, the iRNA agent can be complexed with a moiety that targets the liver, e.g., an antibody or ligand that binds a receptor on the liver.

The iRNA agent, particularly an iRNA agent that targets apoB, beta-catenin or glucose-6-phosphatase RNA, can be targeted to the liver, for example by associating, e.g., conjugating the iRNA agent to a lipophilic moiety, e.g., a lipid, cholesterol, oleyl, retinyl, or cholesteryl residue (see Table 1). Other lipophilic moieties that can be associated, e.g., conjugated with the iRNA agent include cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine. In one embodiment, the iRNA agent can be targeted to the liver by associating, e.g., conjugating, the iRNA agent to a low-density lipoprotein (LDL), e.g., a lactosylated LDL. In another embodiment, the iRNA agent can be targeted to the liver by associating, e.g., conjugating, the iRNA agent to a polymeric carrier complex with sugar residues.

In another embodiment, the iRNA agent can be targeted to the liver by associating, e.g., conjugating, the iRNA agent to a liposome complexed with sugar residues. A targeting agent that incorporates a sugar, e.g., galactose and/or analogues thereof, is particularly useful. These agents target, in particular, the parenchymal cells of the liver (see Table 1). In a preferred embodiment, the targeting moiety includes more than one galactose moiety, preferably two or three. Preferably, the targeting moiety includes 3 galactose moieties, e.g., spaced about 15 angstroms from each other. The targeting moiety can be lactose. A lactose is a glucose coupled to a galactose. Preferably, the targeting moiety includes three lactoses.

The targeting moiety can also be N-Acetyl-Galactosamine, N—Ac-Glucosamine. A mannose, or mannose-6-phosphate targeting moiety can be used for macrophage targeting.

The targeting agent can be linked directly, e.g., covalently or non covalently, to the iRNA agent, or to another delivery or formulation modality, e.g., a liposome. E.g., the iRNA agents with or without a targeting moiety can be incorporated into a delivery modality, e.g., a liposome, with or without a targeting moiety.

It is particularly preferred to use an iRNA conjugated to a lipophilic molecule to conjugate to an iRNA agent that targets apoB, beta-catenin or glucose-6-phosphatase iRNA targeting agent.

In one embodiment, the iRNA agent has been modified, or is associated with a delivery agent, e.g., a delivery agent described herein, e.g., a liposome, which has been modified to alter distribution in favor of the liver. In one embodiment, the modification mediates association with a serum albumin (SA), e.g., a human serum albumin (HSA), or a fragment thereof.

The iRNA agent, particularly an iRNA agent that targets apoB, beta-catenin or glucose-6-phosphatase RNA, can be targeted to the liver, for example by associating, e.g., conjugating the iRNA agent to an SA molecule, e.g., an HSA molecule, or a fragment thereof. In one embodiment, the iRNA agent or composition thereof has an affinity for an SA, e.g., HSA, which is sufficiently high such that its levels in the liver are at least 10, 20, 30, 50, or 100% greater in the presence of SA, e.g., HSA, or is such that addition of exogenous SA will increase delivery to the liver. These criteria can be measured, e.g., by testing distribution in a mouse in the presence or absence of exogenous mouse or human SA.

The SA, e.g., HSA, targeting agent can be linked directly, e.g., covalently or non-covalently, to the iRNA agent, or to another delivery or formulation modality, e.g., a liposome. E.g., the iRNA agents with or without a targeting moiety can be incorporated into a delivery modality, e.g., a liposome, with or without a targeting moiety.

It is particularly preferred to use an iRNA conjugated to an SA, e.g., an HSA, molecule wherein the iRNA agent is an apoB, beta-catenin or glucose-6-phosphatase iRNA targeting agent.

In another aspect, the invention features, a method for reducing glucose-6-phosphatase levels in a subject, e.g., a mammal, such as a human. The method includes administering to a subject an iRNA agent which targets glucose-6-phosphatase. The iRNA agent can be a dsRNA that has a sequence that is substantially identical to a sequence of the glucose-6-phosphatase gene.

In a preferred embodiment, the subject is treated with an iRNA agent which targets one of the sequences listed in Table 7. In a preferred embodiment it targets both sequences of a palindromic pair provided in Table 7. The most preferred targets are listed in descending order of preferrability, in other words, the more preferred targets are listed earlier in Table 7.

In a preferred embodiment the iRNA agent will include regions, or strands, which are complementary to a pair in Table 7. In a preferred embodiment the iRNA agent will include regions complementary to the palindromic pairs of Table 7 as a duplex region.

In a preferred embodiment the duplex region of the iRNA agent will target a sequence listed in Table 7 but will not be perfectly complementary with the target sequence, e.g., it will not be complementary at least 1 base pair. Preferably it will have no more than 1, 2, 3, 4, or 5 bases, in total, or per strand, which do not hybridize with the target sequence In a preferred embodiment the iRNA agent includes overhangs, e.g., 3' or 5' overhangs, preferably one or more 3' overhangs. Overhangs are discussed in detail elsewhere herein but are preferably about 2 nucleotides in length. The overhangs can be complementary to the gene sequences being targeted or can be other sequence. TT is a preferred overhang sequence. The first and second iRNA agent sequences can also be joined, e.g., by additional bases to form a hairpin, or by other non-base linkers.

Table 7 refers to sequences from human glucose-6-phosphatase. Table 8 refers to sequences from rat glucose-6-phosphatase. The sequences from table 8 can be used, e.g., in experiments with rats or cultured rat cells.

In a preferred embodiment iRNA agent can have any architecture, e.g., architecture described herein. E.g., it can be incorporated into an iRNA agent having an overhang structure, overall length, hairpin vs. two-strand structure, as described herein. In addition, monomers other than naturally occurring ribonucleotides can be used in the selected iRNA agent.

The iRNA that targets glucose-6-phosphatase can be administered in an amount sufficient to reduce expression of glucose-6-phosphatase mRNA.

The iRNA that targets glucose-6-phosphatase can be administered to a subject to inhibit hepatic glucose production, for the treatment of glucose-metabolism-related disorders, such as diabetes, e.g., type-2-diabetes mellitus. The iRNA agent can be administered to an individual at risk for the disorder to delay onset of the disorder or a symptom of the disorder.

In other embodiments, iRNA agents having sequence similarity to the following genes can also be used to inhibit hepatic glucose production. These other genes include "forkhead homologue in rhabdomyosarcoma (FKHR); glucagon; glucagon receptor; glycogen phosphorylase; PPAR-Gamma Coactivator (PGC-1); Fructose-1,6-bisphosphatase; glucose-6-phosphate locator; glucokinase inhibitory regulatory protein; and phosphoenolpyruvate carboxykinase (PEPCK).

In one embodiment, the iRNA agent can be targeted to the liver, and RNA expression levels of the targeted genes are decreased in the liver following administration of the iRNA agent.

The iRNA agent can be one described herein, and can be a dsRNA that has a sequence that is substantially identical to a sequence of a target gene. The iRNA can be less than 30 nucleotides in length, e.g., 21-23 nucleotides. Preferably, the iRNA is 21 nucleotides in length. In one embodiment, the iRNA is 21 nucleotides in length, and the duplex region of the iRNA is 19 nucleotides. In another embodiment, the iRNA is greater than 30 nucleotides in length In another aspect, the invention features a method for reducing beta-catenin levels in a subject, e.g., a mammal, such as a human. The method includes administering to a subject an iRNA agent that targets beta-catenin. The iRNA agent can be one described herein, and can be a dsRNA that has a sequence that is substantially identical to a sequence of the beta-catenin gene. The iRNA can be less than 30 nucleotides in length, e.g., 21-23 nucleotides. Preferably, the iRNA is 21 nucleotides in length. In one embodiment, the iRNA is 21 nucleotides in length, and the duplex region of the iRNA is 19 nucleotides. In another embodiment, the iRNA is greater than 30 nucleotides in length.

In a preferred embodiment, the subject is treated with an iRNA agent which targets one of the sequences listed in Table 9. In a preferred embodiment it targets both sequences of a palindromic pair provided in Table 9. The most preferred targets are listed in descending order of preferrability, in other words, the more preferred targets are listed earlier in Table 9.

In a preferred embodiment, the subject is treated with an iRNA agent which targets one of the sequences listed in Table 9. In a preferred embodiment it targets both sequences of a palindromic pair provided in Table 9. The most preferred targets are listed in descending order of preferrability, in other words, the more preferred targets are listed earlier in Table 9.

In a preferred embodiment the iRNA agent will include regions, or strands, which are complementary to a pair in Table 9. In a preferred embodiment the iRNA agent will include regions complementary to the palindromic pairs of Table 9 as a duplex region.

In a preferred embodiment the duplex region of the iRNA agent will target a sequence listed in Table 9 but will not be perfectly complementary with the target sequence, e.g., it will not be complementary at least 1 base pair. Preferably it will have no more than 1, 2, 3, 4, or 5 bases, in total, or per strand, which do not hybridize with the target sequence In a preferred embodiment the iRNA agent includes overhangs, e.g., 3' or 5' overhangs, preferably one or more 3' overhangs. Overhangs are discussed in detail elsewhere herein but are preferably about 2 nucleotides in length. The overhangs can be complementary to the gene sequences being targeted or can be other sequence. TT is a preferred overhang sequence. The first and second iRNA agent sequences can also be joined, e.g., by additional bases to form a hairpin, or by other non-base linkers.

The iRNA agent that targets beta-catenin can be administered in an amount sufficient to reduce expression of beta-catenin mRNA. In one embodiment, the iRNA agent is administered in an amount sufficient to reduce expression of beta-catenin protein (e.g., by at least 2%, 4%, 6%, 10%, 15%, 20%).

The iRNA agent that targets beta-catenin can be administered to a subject, wherein the subject is suffering from a disorder characterized by unwanted cellular proliferation in the liver or of liver tissue, e.g., metastatic tissue originating from the liver. Examples include, a benign or malignant disorder, e.g., a cancer, e.g., a hepatocellular carcinoma (HCC), hepatic metastasis, or hepatoblastoma.

The iRNA agent can be administered to an individual at risk for the disorder to delay onset of the disorder or a symptom of the disorder In a preferred embodiment the iRNA agent is administered repeatedly. Administration of an iRNA agent can be carried out over a range of time periods. It can be administered daily, once every few days, weekly, or monthly. The timing of administration can vary from patient to patient, depending on such factors as the severity of a patient's symptoms. For example, an effective dose of an iRNA agent can be administered to a patient once a month for an indefinite period of time, or until the patient no longer requires therapy. In addition, sustained release compositions containing an iRNA agent can be used to maintain a relatively constant dosage in the patient's blood.

In one embodiment, the iRNA agent can be targeted to the liver, and beta-catenin expression level are decreased in the liver following administration of the beta-catenin iRNA agent. For example, the iRNA agent can be complexed with a moiety that targets the liver, e.g., an antibody or ligand that binds a receptor on the liver.

In another aspect, the invention provides methods to treat liver disorders, e.g., disorders characterized by unwanted cell proliferation, hematological disorders, disorders characterized by inflammation disorders, and metabolic or viral diseases or disorders of the liver. A proliferation disorder of the liver can be, for example, a benign or malignant disorder, e.g., a cancer, e.g, a hepatocellular carcinoma (HCC), hepatic metastasis, or hepatoblastoma. A hepatic hematology or inflammation disorder can be a disorder involving clotting factors, a complement-mediated inflammation or a fibrosis, for example. Metabolic diseases of the liver can include dyslipidemias, and irregularities in glucose regulation. Viral diseases of the liver can include hepatitis C or hepatitis B. In one embodiment, a liver disorder is treated by administering one or more iRNA agents that have a sequence that is substantially identical to a sequence in a gene involved in the liver disorder.

In one embodiment an iRNA agent to treat a liver disorder has a sequence which is substantially identical to a sequence of the beta-catenin or c-jun gene. In another embodiment, such as for the treatment of hepatitis C or hepatitis B, the iRNA agent can have a sequence that is substantially identical to a sequence of a gene of the hepatitis C virus or the hepatitis B virus, respectively. For example, the iRNA agent can target the 5' core region of HCV. This region lies just downstream of the ribosomal toe-print straddling the initiator methionine. Alternatively, an iRNA agent of the invention can target any one of the nonstructural proteins of HCV: NS3, 4A, 4B, 5A, or 5B. For the treatment of hepatitis B, an iRNA agent can target the protein X (HBx) gene, for example.

In a preferred embodiment, the subject is treated with an iRNA agent which targets one of the sequences listed in Table 10. In a preferred embodiment it targets both sequences of a palindromic pair provided in Table 10. The most preferred targets are listed in descending order of preferrability, in other words, the more preferred targets are listed earlier in Table 10.

In a preferred embodiment the iRNA agent will include regions, or strands, which are complementary to a pair in Table 10. In a preferred embodiment the iRNA agent will include regions complementary to the palindromic pairs of Table 10 as a duplex region.

In a preferred embodiment the duplex region of the iRNA agent will target a sequence listed in Table 10, but will not be perfectly complementary with the target sequence, e.g., it will not be complementary at least 1 base pair. Preferably it will have no more than 1, 2, 3, 4, or 5 bases, in total, or per strand, which do not hybridize with the target sequence In a preferred embodiment the iRNA agent includes overhangs, e.g., 3' or 5' overhangs, preferably one or more 3' overhangs. Overhangs are discussed in detail elsewhere herein but are preferably about 2 nucleotides in length. The overhangs can be complementary to the gene sequences being targeted or can be other sequence. TT is a preferred overhang sequence. The first and second iRNA agent sequences can also be joined, e.g., by additional bases to form a hairpin, or by other non-base linkers.

In another aspect, an iRNA agent can be administered to modulate blood clotting, e.g., to reduce the tendency to form a blood clot. In a preferred embodiment the iRNA agent targets Factor V expression, preferably in the liver. One or more iRNA agents can be used to target a wild type allele, a mutant allele, e.g., the Leiden Factor V allele, or both. Such administration can be used to treat or prevent venous thrombosis, e.g., deep vein thrombosis or pulmonary embolism, or another disorder caused by elevated or otherwise unwanted expression of Factor V, in, e.g., the liver. In one embodiment the iRNA agent can treat a subject, e.g., a human who has Factor V Leiden or other genetic trait associated with an unwanted tendency to form blood clots.

In a preferred embodiment administration of an iRNA agent which targets Factor V is with the administration of a second treatment, e.g, a treatment which reduces the tendency of the blood to clot, e.g., the administration of heparin or of a low molecular weight heparin.

In one embodiment, the iRNA agent that targets Factor V can be used as a prophylaxis in patients, e.g., patients with Factor V Leiden, who are placed at risk for a thrombosis, e.g., those about to undergo surgery, in particular those about to undergo high-risk surgical procedures known to be associated with formation of venous thrombosis, those about to undergo a prolonged period of relative inactivity, e.g., on a motor vehicle, train or airplane flight, e.g., a flight or other trip lasting more than three or five hours. Such a treatment can be an adjunct to the therapeutic use of low molecular weight (LMW) heparin prophylaxis.

In another embodiment, the iRNA agent that targets Factor V can be administered to patients with Factor V Leiden to treat deep vein thrombosis (DVT) or pulmonary embolism (PE). Such a treatment can be an adjunct to (or can replace) therapeutic uses of heparin or coumadin. The treatment can be administered by inhalation or generally by pulmonary routes.

In a preferred embodiment, an iRNA agent administered to treat a liver disorder is targeted to the liver. For example, the iRNA agent can be complexed with a targeting moiety, e.g., an antibody or ligand that recognizes a liver-specific receptor.

The invention also includes preparations, including substantially pure or pharmaceutically acceptable preparations of iRNA agents which silence any of the genes discussed herein and in particular for any of apoB-100, glucose-6-phosphatase, beta-catenin, factor V, or any of the HVC genes discussed herein.

The methods and compositions of the invention, e.g., the methods and compositions to treat diseases and disorders of the liver described herein, can be used with any of the iRNA agents described. In addition, the methods and compositions of the invention can be used for the treatment of any disease or disorder described herein, and for the treatment of any subject, e.g., any animal, any mammal, such as any human.

In another aspect, the invention features, a method of selecting two sequences or strands for use in an iRNA agent. The method includes:

providing a first candidate sequence and a second candidate sequence;

determining the value of a parameter which is a function of the number of palindromic pairs between the first and second sequence, wherein a palindromic pair is a nucleotide on said first sequence which, when the sequences are aligned in anti-parallel orientation, will hybridize with a nucleotide on said second sequence;

comparing the number with a predetermined reference value, and if the number has a predetermined relationship with the reference, e.g., if it is the same or greater, selecting the sequences for use in an iRNA agent. In most cases each of the two sequences will be completely complementary with a target sequence (though as described elsewhere herein that may not always be the case, there may not be perfect complementarity with one or both of the target sequences) and will have sufficient complementarity with each other to form a duplex. The parameter can be derived e.g., by directly determining the number of palindromic pairs, e.g., by inspection or by the use of a computer program which compares or analyses sequence. The parameter can also be determined less directly, and include e.g., calculation of or measurement of the Tm or other value related to the free energy of association or dissociation of a duplex.

In a preferred embodiment the determination can be performed on a target sequence, e.g., a genomic sequence. In such embodiments the selected sequence is converted to its complement in the iRNA agent.

In a preferred embodiment the first and second sequences are selected from the sequence of a single target gene. In other embodiments the first sequence is selected from the sequence of a first target gene and the second sequence is selected from the target of a second target gene.

In a preferred embodiment the method includes comparing blocks of sequence, e.g., blocks which are between 15 and 25 nucleotides in length, and preferably 19, 20, or 21, and most preferably 19 nucleotides in length, to determine if they are suitable for use, e.g., if they possess sufficient palindromic pairs.

In a preferred embodiment the first and second sequences are divided into a plurality of regions, e.g., terminal regions and a middle region disposed between the terminal regions and where in the reference value, or the predetermined relationship to the reference value, is different for at least two regions. E.g., the first and second sequences, when aligned in anti-parallel orientation, are divided into terminal regions each of a selected number of base pairs, e.g., 2, 3, 4, 5, or 6, and a middle region, and the reference value for the terminal regions is higher than for the middle regions. In other words, a higher number or proportion of palindromic pairs is required in the terminal regions.

In a preferred embodiment the first and second sequences are gene sequences thus the complements of the sequences will be used in a iRNA agent.

In a preferred embodiment hybridize means a classical Watson-Crick pairing. In other embodiments hybridize can include non-Watson-Crick paring, e.g., parings seen in micro RNA precursors.

In a preferred embodiment the method includes the addition of nucleotides to form overhangs, e.g., 3' or 5' overhangs, preferably one or more 3' overhangs. Overhangs are discussed in detail elsewhere herein but are preferably about 2 nucleotides in length. The overhangs can be complementary to the gene sequences being targeted or can be other sequence.

TT is a preferred overhang sequence. The first and second iRNA agent sequences can also be joined, e.g., by additional bases to form a hairpin, or by other non-base linkers.

In a preferred embodiment the method is used to select all or part of a iRNA agent. The selected sequences can be incorporated into an iRNA agent having any architecture, e.g., an architecture described herein. E.g., it can be incorporated into an iRNA agent having an overhang structure, overall length, hairpin vs. two-strand structure, as described herein. In addition, monomers other than naturally occurring ribonucleotides can be used in the selected iRNA agent.

Preferred iRNA agents of this method will target genes expressed in the liver, e.g., one of the genes disclosed herein, e.g., apo B, Beta catenin, an HVC gene, or glucose 6 phosphatase.

In another aspect, the invention features, an iRNA agent, determined, made, or selected by a method described herein.

The methods and compositions of the invention, e.g., the methods and iRNA compositions to treat liver-based diseases described herein, can be used with any dosage and/or formulation described herein, as well as with any route of administration described herein.

The invention also provides for the use of an iRNA agent which includes monomers which can form other than a canonical Watson-Crick pairing with another monomer, e.g., a monomer on another strand.

The use of "other than canonical Watson-Crick pairing" between monomers of a duplex can be used to control, often to promote, melting of all or part of a duplex. The iRNA agent can include a monomer at a selected or constrained position that results in a first level of stability in the iRNA agent duplex (e.g., between the two separate molecules of a double stranded iRNA agent) and a second level of stability in a duplex between a sequence of an iRNA agent and another sequence molecule, e.g., a target or off-target sequence in a subject. In some cases the second duplex has a relatively greater level of stability, e.g., in a duplex between an anti-sense sequence of an iRNA agent and a target mRNA. In this case one or more of the monomers, the position of the monomers in the iRNA agent, and the target sequence (sometimes referred to herein as the selection or constraint parameters), are selected such that the iRNA agent duplex is has a comparatively lower free energy of association (which while not wishing to be bound by mechanism or theory, is believed to contribute to efficacy by promoting disassociation of the duplex iRNA agent in the context of the RISC) while the duplex formed between an anti-sense targeting sequence and its target sequence, has a relatively higher free energy of association (which while not wishing to be bound by mechanism or theory, is believed to contribute to efficacy by promoting association of the anti-sense sequence and the target RNA).

In other cases the second duplex has a relatively lower level of stability, e.g., in a duplex between a sense sequence of an iRNA agent and an off-target mRNA. In this case one or more of the monomers, the position of the monomers in the iRNA agent, and an off-target sequence, are selected such that the iRNA agent duplex is has a comparatively higher free energy of association while the duplex formed between a sense targeting sequence and its off-target sequence, has a relatively lower free energy of association (which while not wishing to be bound by mechanism or theory, is believed to reduce the level of off-target silencing by contribute to efficacy by promoting disassociation of the duplex formed by the sense strand and the off-target sequence).

Thus, inherent in the structure of the iRNA agent is the property of having a first stability for the intra-iRNA agent duplex and a second stability for a duplex formed between a sequence from the iRNA agent and another RNA, e.g., a target mRNA. As discussed above, this can be accomplished by judicious selection of one or more of the monomers at a selected or constrained position, the selection of the position in the duplex to place the selected or constrained position, and selection of the sequence of a target sequence (e.g., the particular region of a target gene which is to be targeted). The iRNA agent sequences which satisfy these requirements are sometimes referred herein as constrained sequences. Exercise of the constraint or selection parameters can be, e.g., by inspection, or by computer assisted methods. Exercise of the parameters can result in selection of a target sequence and of particular monomers to give a desired result in terms of the stability, or relative stability, of a duplex.

Thus, in one aspect, the invention features, an iRNA agent which includes: a first sequence which targets a first target region and a second sequence which targets a second target region. The first and second sequences have sufficient complementarity to each other to hybridize, e.g., under physiological conditions, e.g., under physiological conditions but not in contact with a helicase or other unwinding enzyme. In a duplex region of the iRNA agent, at a selected or constrained position, the first target region has a first monomer, and the second target region has a second monomer. The first and second monomers occupy complementary or corresponding positions. One, and preferably both monomers are selected such that the stability of the pairing of the monomers contribute to a duplex between the first and second sequence will differ form the stability of the pairing between the first or second sequence with a target sequence.

Usually, the monomers will be selected (selection of the target sequence may be required as well) such that they form a pairing in the iRNA agent duplex which has a lower free energy of dissociation, and a lower Tm, than will be possessed by the paring of the monomer with its complementary monomer in a duplex between the iRNA agent sequence and a target RNA duplex.

The constraint placed upon the monomers can be applied at a selected site or at more than one selected site. By way of example, the constraint can be applied at more than 1, but less than 3, 4, 5, 6, or 7 sites in an iRNA agent duplex.

A constrained or selected site can be present at a number of positions in the iRNA agent duplex. E.g., a constrained or selected site can be present within 3, 4, 5, or 6 positions from either end, 3' or 5' of a duplexed sequence. A constrained or selected site can be present in the middle of the duplex region, e.g., it can be more than 3, 4, 5, or 6, positions from the end of a duplexed region.

The iRNA agent can be selected to target a broad spectrum of genes, including any of the genes described herein.

In a preferred embodiment the iRNA agent has an architecture (architecture refers to one or more of overall length, length of a duplex region, the presence, number, location, or length of overhangs, sing strand versus double strand form) described herein.

E.g., the iRNA agent can be less than 30 nucleotides in length, e.g., 21-23 nucleotides. Preferably, the iRNA is 21 nucleotides in length and there is a duplex region of about 19 pairs. In one embodiment, the iRNA is 21 nucleotides in length, and the duplex region of the iRNA is 19 nucleotides. In another embodiment, the iRNA is greater than 30 nucleotides in length.

In some embodiment the duplex region of the iRNA agent will have, mismatches, in addition to the selected or constrained site or sites. Preferably it will have no more than 1, 2, 3, 4, or 5 bases, which do not form canonical Watson-Crick pairs or which do not hybridize. Overhangs are discussed in detail elsewhere herein but are preferably about 2 nucleotides in length. The overhangs can be complementary to the gene sequences being targeted or can be other sequence. TT is a preferred overhang sequence. The first and second iRNA agent sequences can also be joined, e.g., by additional bases to form a hairpin, or by other non-base linkers.

The monomers can be selected such that: first and second monomers are naturally occurring ribonucleotides, or modified ribonucleotides having naturally occurring bases, and when occupying complementary sites either do not pair and have no substantial level of H-bonding, or form a non canonical Watson-Crick pairing and form a non-canonical pattern of H bonding, which usually have a lower free energy of dissociation than seen in a canonical Watson-Crick pairing, or otherwise pair to give a free energy of association which is less than that of a preselected value or is less, e.g., than that of a canonical pairing. When one (or both) of the iRNA agent sequences duplexes with a target, the first (or second) monomer forms a canonical Watson-Crick pairing with the base in the complementary position on the target, or forms a non canonical Watson-Crick pairing having a higher free energy of dissociation and a higher Tm than seen in the paring in the iRNA agent. The classical Watson-Crick parings are as follows: A-T, G-C, and A-U. Non-canonical Watson-Crick pairings are known in the art and can include, U-U, G-G, G-Atrans, G-Acis, and GU.

The monomer in one or both of the sequences is selected such that, it does not pair, or forms a pair with its corresponding monomer in the other sequence which minimizes stability (e.g., the H bonding formed between the monomer at the selected site in the one sequence and its monomer at the corresponding site in the other sequence are less stable than the H bonds formed by the monomer one (or both) of the sequences with the respective target sequence. The monomer in one or both strands is also chosen to promote stability in one or both of the duplexes made by a strand and its target sequence. E.g., one or more of the monomers and the target sequences are selected such that at the selected or constrained position, there is are no H bonds formed, or a non canonical pairing is formed in the iRNA agent duplex, or otherwise they otherwise pair to give a free energy of association which is less than that of a preselected value or is less, e.g., than that of a canonical pairing, but when one (or both) sequences form a duplex with the respective target, the pairing at the selected or constrained site is a canonical Watson-Crick pairing.

The inclusion of such a monomers will have one or more of the following effects: it will destabilize the iRNA agent duplex, it will destabilize interactions between the sense sequence and unintended target sequences, sometimes referred to as off-target sequences, and duplex interactions between the a sequence and the intended target will not be destabilized.

By way of example:

the monomer at the selected site in the first sequence includes an A (or a modified base which pairs with T), and the monomer in at the selected position in the second sequence is chosen from a monomer which will not pair or which will form a non-canonical pairing, e.g., G. These will be useful in applications wherein the target sequence for the first sequence has a T at the selected position. In embodiments where both target duplexes are stabilized it is useful wherein the target sequence for the second strand has a monomer which will form a canonical Watson-Crick pairing with the monomer selected for the selected position in the second strand.

the monomer at the selected site in the first sequence includes U (or a modified base which pairs with A), and the monomer in at the selected position in the second sequence is chosen from a monomer which will not pair or which will form a non-canonical pairing, e.g., U or G. These will be useful in applications wherein the target sequence for the first sequence has a T at the selected position. In embodiments where both target duplexes are stabilized it is useful wherein the target sequence for the second strand has a monomer which will form a canonical Watson-Crick pairing with the monomer selected for the selected position in the second strand.

The monomer at the selected site in the first sequence includes a G (or a modified base which pairs with C), and the monomer in at the selected position in the second sequence is chosen from a monomer which will not pair or which will form a non-canonical pairing, e.g., G, Acis, Atrans, or U. These will be useful in applications wherein the target sequence for the first sequence has a T at the selected position. In embodiments where both target duplexes are stabilized it is useful wherein the target sequence for the second strand has a monomer which will form a canonical Watson-Crick pairing with the monomer selected for the selected position in the second strand.

The monomer at the selected site in the first sequence includes a C (or a modified base which pairs with G), and the monomer in at the selected position in the second sequence is chosen a monomer which will not pair or which will form a non-canonical pairing. These will be useful in applications wherein the target sequence for the first sequence has a T at the selected position. In embodiments where both target duplexes are stabilized it is useful wherein the target sequence for the second strand has a monomer which will form a canonical Watson-Crick pairing with the monomer selected for the selected position in the second strand.

In another embodiment a non-naturally occurring or modified monomer or monomers are chosen such that when a non-naturally occurring or modified monomer occupies a positions at the selected or constrained position in an iRNA agent they exhibit a first free energy of dissociation and when one (or both) of them pairs with a naturally occurring monomer, the pair exhibits a second free energy of dissociation, which is usually higher than that of the pairing of the first and second monomers. E.g., when the first and second monomers occupy complementary positions they either do not pair and have no substantial level of H-bonding, or form a weaker bond than one of them would form with a naturally occurring monomer, and reduce the stability of that duplex, but when the duplex dissociates at least one of the strands will form a duplex with a target in which the selected monomer will promote stability, e.g., the monomer will form a more stable pair with a naturally occurring monomer in the target sequence than the pairing it formed in the iRNA agent.

An example of such a pairing is 2-amino A and either of a 2-thio pyrimidine analog of U or T.

When placed in complementary positions of the iRNA agent these monomers will pair very poorly and will minimize stability. However, a duplex is formed between 2 amino A and the U of a naturally occurring target, or a duplex is between 2-thio U and the A of a naturally occurring target or 2-thio T and the A of a naturally occurring target will have a relatively higher free energy of dissociation and be more stable. This is shown in the FIG. 1.

The pair shown in FIG. 1 (the 2-amino A and the 2-s U and T) is exemplary. In another embodiment, the monomer at the selected position in the sense strand can be a universal pairing moiety. A universal pairing agent will form some level of H bonding with more than one and preferably all other naturally occurring monomers. An example of a universal pairing moiety is a monomer which includes 3-nitro pyrrole. (Examples of other candidate universal base analogs can be found in the art, e.g., in Loakes, 2001, NAR 29: 2437-2447, hereby incorporated by reference. Examples can also be found in the section on Universal Bases below.) In these cases the monomer at the corresponding position of the anti-sense strand can be chosen for its ability to form a duplex with the target and can include, e.g., A, U, G, or C.

In another aspect, the invention features, an iRNA agent which includes: a sense sequence, which preferably does not target a sequence in a subject, and an anti-sense sequence, which targets a target gene in a subject. The sense and anti-sense sequences have sufficient complementarity to each other to hybridize hybridize, e.g., under physiological conditions, e.g., under physiological conditions but not in contact with a helicase or other unwinding enzyme. In a duplex region of the iRNA agent, at a selected or constrained position, the monomers are selected such that:

the monomer in the sense sequence is selected such that, it does not pair, or forms a pair with its corresponding monomer in the anti-sense strand which minimizes stability (e.g., the H bonding formed between the monomer at the selected site in the sense strand and its monomer at the corresponding site in the anti-sense strand are less stable than the H bonds formed by the monomer of the anti-sense sequence and its canonical Watson-Crick partner or, if the monomer in the anti-sense strand includes a modified base, the natural analog of the modified base and its canonical Watson-Crick partner);

the monomer is in the corresponding position in the anti-sense strand is selected such that it maximizes the stability of a duplex it forms with the target sequence, e.g., it forms a canonical Watson-Crick paring with the monomer in the corresponding position on the target stand;

optionally, the monomer in the sense sequence is selected such that, it does not pair, or forms a pair with its corresponding monomer in the anti-sense strand which minimizes stability with an off-target sequence.

The inclusion of such a monomers will have one or more of the following effects: it will destabilize the iRNA agent duplex, it will destabilize interactions between the sense sequence and unintended target sequences, sometimes referred to as off-target sequences, and duplex interactions between the anti-sense strand and the intended target will not be destabilized.

The constraint placed upon the monomers can be applied at a selected site or at more than one selected site. By way of example, the constraint can be applied at more than 1, but less than 3, 4, 5, 6, or 7 sites in an iRNA agent duplex.

A constrained or selected site can be present at a number of positions in the iRNA agent duplex. E.g., a constrained or selected site can be present within 3, 4, 5, or 6 positions from either end, 3' or 5' of a duplexed sequence. A constrained or selected site can be present in the middle of the duplex region, e.g., it can be more than 3, 4, 5, or 6, positions from the end of a duplexed region.

The iRNA agent can be selected to target a broad spectrum of genes, including any of the genes described herein.

In a preferred embodiment the iRNA agent has an architecture (architecture refers to one or more of overall length, length of a duplex region, the presence, number, location, or length of overhangs, sing strand versus double strand form) described herein.

E.g., the iRNA agent can be less than 30 nucleotides in length, e.g., 21-23 nucleotides. Preferably, the iRNA is 21 nucleotides in length and there is a duplex region of about 19 pairs. In one embodiment, the iRNA is 21 nucleotides in length, and the duplex region of the iRNA is 19 nucleotides. In another embodiment, the iRNA is greater than 30 nucleotides in length.

In some embodiment the duplex region of the iRNA agent will have, mismatches, in addition to the selected or constrained site or sites. Preferably it will have no more than 1, 2, 3, 4, or 5 bases, which do not form canonical Watson-Crick pairs or which do not hybridize. Overhangs are discussed in detail elsewhere herein but are preferably about 2 nucleotides in length. The overhangs can be complementary to the gene sequences being targeted or can be other sequence. TT is a preferred overhang sequence. The first and second iRNA agent sequences can also be joined, e.g., by additional bases to form a hairpin, or by other non-base linkers.

One or more selection or constraint parameters can be exercised such that: monomers at the selected site in the sense and anti-sense sequences are both naturally occurring ribonucleotides, or modified ribonucleotides having naturally occurring bases, and when occupying complementary sites in the iRNA agent duplex either do not pair and have no substantial level of H-bonding, or form a non-canonical Watson-Crick pairing and thus form a non-canonical pattern of H bonding, which generally have a lower free energy of dissociation than seen in a Watson-Crick pairing, or otherwise pair to give a free energy of association which is less than that of a preselected value or is less, e.g., than that of a canonical pairing. When one, usually the anti-sense sequence of the iRNA agent sequences forms a duplex with another sequence, generally a sequence in the subject, and generally a target sequence, the monomer forms a classic Watson-Crick pairing with the base in the complementary position on the target, or forms a non-canonical Watson-Crick pairing having a higher free energy of dissociation and a higher Tm than seen in the paring in the iRNA agent. Optionally, when the other sequence of the iRNA agent, usually the sense sequences forms a duplex with another sequence, generally a sequence in the subject, and generally an off-target sequence, the monomer fails to forms a canonical Watson-Crick pairing with the base in the complementary position on the off target sequence, e.g., it forms or forms a non-canonical Watson-Crick pairing having a lower free energy of dissociation and a lower Tm.

By way of example:

the monomer at the selected site in the anti-sense stand includes an A (or a modified base which pairs with T), the corresponding monomer in the target is a T, and the sense strand is chosen from a base which will not pair or which will form a noncanonical pair, e.g., G;

the monomer at the selected site in the anti-sense stand includes a U (or a modified base which pairs with A), the corresponding monomer in the target is an A, and the sense strand is chosen from a monomer which will not pair or which will form a non-canonical pairing, e.g., U or G;

the monomer at the selected site in the anti-sense stand includes a C (or a modified base which pairs with G), the corresponding monomer in the target is a G, and the sense strand is chosen a monomer which will not pair or which will form a non-canonical pairing, e.g., G. $A_{cis}$, $A_{trans}$, or U; or the monomer at the selected site in the anti-sense stand includes a G (or a modified base which pairs with C), the corresponding monomer in the target is a C, and the sense strand is chosen from a monomer which will not pair or which will form a non-canonical pairing.

In another embodiment a non-naturally occurring or modified monomer or monomers is chosen such that when it occupies complementary a position in an iRNA agent they exhibit a first free energy of dissociation and when one (or both) of them pairs with a naturally occurring monomer, the pair exhibits a second free energy of dissociation, which is usually higher than that of the pairing of the first and second monomers. E.g., when the first and second monomers occupy complementary positions they either do not pair and have no substantial level of H-bonding, or form a weaker bond than one of them would form with a naturally occurring monomer, and reduce the stability of that duplex, but when the duplex dissociates at least one of the strands will form a duplex with a target in which the selected monomer will promote stability, e.g., the monomer will form a more stable pair with a naturally occurring monomer in the target sequence than the pairing it formed in the iRNA agent.

An example of such a pairing is 2-amino A and either of a 2-thio pyrimidine analog of U or T. As is discussed above, when placed in complementary positions of the iRNA agent these monomers will pair very poorly and will minimize stability. However, a duplex is formed between 2 amino A and the U of a naturally occurring target, or a duplex is formed between 2-thio U and the A of a naturally occurring target or 2-thio T and the A of a naturally occurring target will have a relatively higher free energy of dissociation and be more stable.

The monomer at the selected position in the sense strand can be a universal pairing moiety. A universal pairing agent will form some level of H bonding with more than one and preferably all other naturally occurring monomers. An examples of a universal pairing moiety is a monomer which includes 3-nitro pyrrole. Examples of other candidate universal base analogs can be found in the art, e.g., in Loakes, 2001, NAR 29: 2437-2447, hereby incorporated by reference. In these cases the monomer at the corresponding position of the anti-sense strand can be chosen for its ability to form a duplex with the target and can include, e.g., A, U, G, or C.

In another aspect, the invention features, an iRNA agent which includes: a sense sequence, which preferably does not target a sequence in a subject, and an anti-sense sequence, which targets a plurality of target sequences in a subject, wherein the targets differ in sequence at only 1 or a small number, e.g., no more than 5, 4, 3 or 2 positions. The sense and anti-sense sequences have sufficient complementarity to each other to hybridize, e.g., under physiological conditions, e.g., under physiological conditions but not in contact with a helicase or other unwinding enzyme. In the sequence of the anti-sense strand of the iRNA agent is selected such that at one, some, or all of the positions which correspond to positions that differ in sequence between the target sequences, the anti-sense strand will include a monomer which will form H-bonds with at least two different target sequences. In a preferred example the anti-sense sequence will include a universal or promiscuous monomer, e.g., a monomer which includes 5-nitro pyrrole, 2-amino A, 2-thio U or 2-thio T, or other universal base referred to herein.

In a preferred embodiment the iRNA agent targets repeated sequences (which differ at only one or a small number of positions from each other) in a single gene, a plurality of genes, or a viral genome, e.g., the HCV genome.

An embodiment is illustrated in the FIGS. 2 and 3.

In another aspect, the invention features, determining, e.g., by measurement or calculation, the stability of a pairing between monomers at a selected or constrained position in the iRNA agent duplex, and preferably determining the stability for the corresponding pairing in a duplex between a sequence form the iRNA agent and another RNA, e.g., a target sequence. The determinations can be compared. An iRNA agent thus analyzed can be used in the development of a further modified iRNA agent or can be administered to a subject. This analysis can be performed successively to refine or design optimized iRNA agents.

In another aspect, the invention features, a kit which includes one or more of the following an iRNA described herein, a sterile container in which the iRNA agent is disclosed, and instructions for use.

In another aspect, the invention features, an iRNA agent containing a constrained sequence made by a method described herein. The iRNA agent can target one or more of the genes referred to herein.

iRNA agents having constrained or selected sites, e.g., as described herein, can be used in any way described herein. Accordingly, they iRNA agents having constrained or selected sites, e.g., as described herein, can be used to silence a target, e.g., in any of the methods described herein and to target any of the genes described herein or to treat any of the disorders described herein. iRNA agents having constrained or selected sites, e.g., as described herein, can be incorporated into any of the formulations or preparations, e.g., pharmaceutical or sterile preparations described herein. iRNA agents having constrained or selected sites, e.g., as described herein, can be administered by any of the routes of administration described herein.

The term "other than canonical Watson-Crick pairing" as used herein, refers to a pairing between a first monomer in a first sequence and a second monomer at the corresponding position in a second sequence of a duplex in which one or more of the following is true: (1) there is essentially no pairing between the two, e.g., there is no significant level of H bonding between the monomers or binding between the monomers does not contribute in any significant way to the stability of the duplex; (2) the monomers are a non-canonical paring of monomers having a naturally occurring bases, i.e., they are other than A-T, A-U, or G-C, and they form monomer-monomer H bonds, although generally the H bonding pattern formed is less strong than the bonds formed by a canonical pairing; or (3) at least one of the monomers includes a non-naturally occurring bases and the H bonds formed between the monomers is, preferably formed is less strong than the bonds formed by a canonical pairing, namely one or more of A-T, A-U, G-C.

The term "off-target" as used herein, refers to a sequence other than the sequence to be silenced.

Universal Bases: "wild-cards"; shape-based complementarity

Bi-stranded, multisite replication of a base pair between difluorotoluene and adenine: confirmation by 'inverse' sequencing. Liu, D.; Moran, S.; Kool, E. T. *Chem. Biol.*, 1997, 4, 919-926)

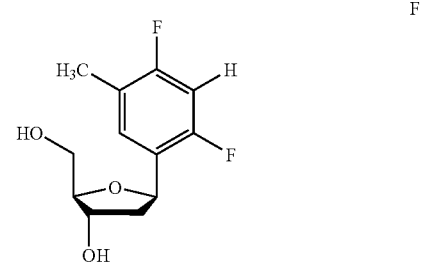

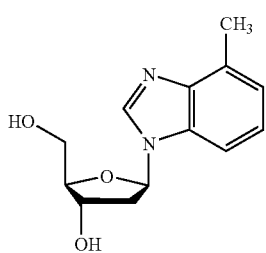

(Importance of terminal base pair hydrogen-bonding in 3'-end proofreading by the Klenow fragment of DNA polymerase I. Morales, J. C.; Kool, E. T. *Biochemistry*, 2000, 39, 2626-2632)

(Selective and stable DNA base pairing without hydrogen bonds. Matray, T, J.; Kool, E. T. *J. Am. Chem. Soc.*, 1998, 120, 6191-6192)

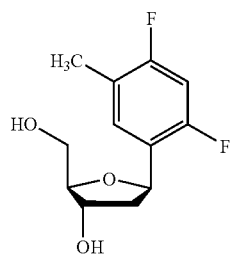

(Difluorotoluene, a nonpolar isostere for thymine, codes specifically and efficiently for adenine in DNA replication. Moran, S. Ren, R. X.-F.; Rumney IV, S.; Kool, E. T. *J. Am. Chem. Soc.*, 1997, 119, 2056-2057)

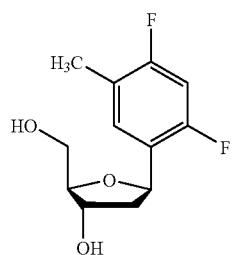

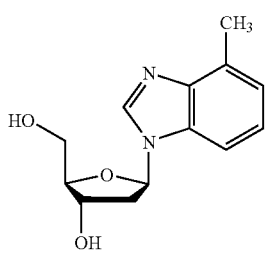

(Structure and base pairing properties of a replicable non-polar isostere for deoxyadenosine. Guckian, K. M.; Morales, J. C.; Kool, E. T. *J. Org. Chem.*, 1998, 63, 9652-9656)

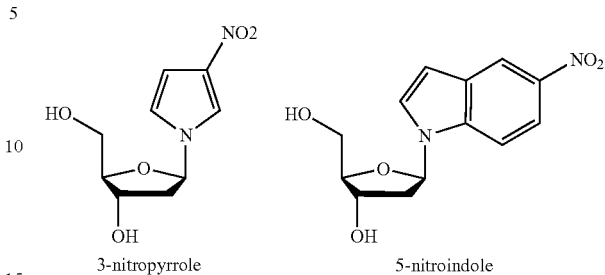

3-nitropyrrole      5-nitroindole

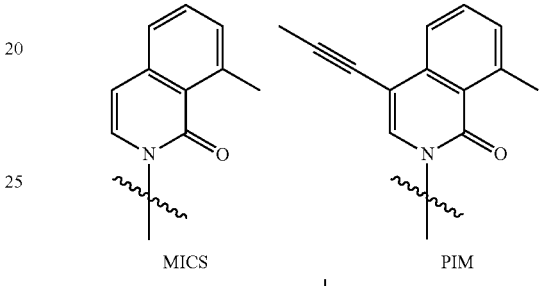

MICS      PIM

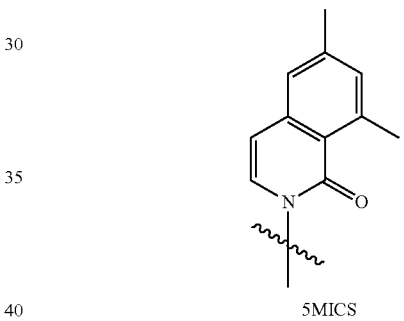

5MICS (Universal bases for hybridization, replication and chain termination. Berger, M.; Wu. Y.; Ogawa, A. K.; McMinn, D. L.; Schultz, P. G.; Romesberg, F. E. *Nucleic Acids Res.*, 2000, 28, 2911-2914)

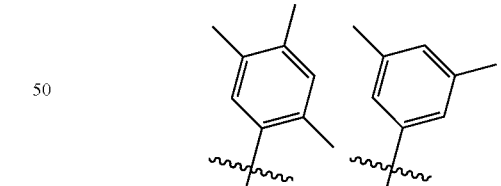

TM      DM

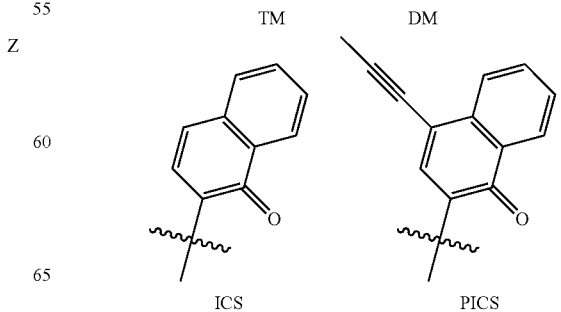

ICS      PICS

-continued

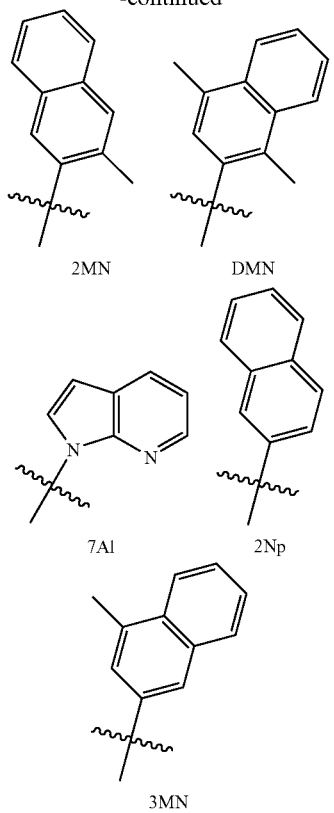

2MN  DMN

7AI  2Np

3MN (1. Efforts toward the expansion of the genetic alphabet: Information storage and replication with unnatural hydrophobic base pairs. Ogawa, A. K.; Wu, Y.; McMinn, D. L.; Liu, J.; Schultz, P. G.; Romesberg, F. E. *J. Am. Chem. Soc.*, 2000, 122, 3274-3287. 2. Rational design of an unnatural base pair with increased kinetic selectivity. Ogawa, A. K.; Wu. Y.; Berger, M.; Schultz, P. G.; Romesberg, F. E. *J. Am. Chem. Soc.*, 2000, 122, 8803-8804)

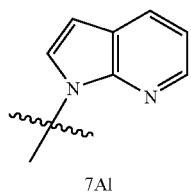

7AI (Efforts toward expansion of the genetic alphabet: replication of DNA with three base pairs. Tae, E. L.; Wu, Y.; Xia, G.; Schultz, P. G.; Romesberg, F. E. *J. Am. Chem. Soc.*, 2001, 123, 7439-7440)

(1. Efforts toward expansion of the genetic alphabet: Optimization of interbase hydrophobic interactions. Wu, Y.; Ogawa, A. K.; Berger, M.; McMinn, D. L.; Schultz, P. G.; Romesberg, F. E. *J. Am. Chem. Soc.*, 2000, 122, 7621-7632. 2. Efforts toward expansion of genetic alphabet: DNA polymerase recognition of a highly stable, self-pairing hydrophobic base. McMinn, D. L.; Ogawa. A. K.; Wu, Y.; Liu, J.; Schultz, P. G.; Romesberg, F. E. *J. Am. Chem. Soc.*, 1999, 121, 11585-11586)

(A stable DNA duplex containing a non-hydrogen-bonding and non-shape complementary base couple: Interstrand stacking as the stability determining factor. Brotschi, C.; Haberli, A.; Leumann, C, J. *Angew. Chem. Int. Ed.*, 2001, 40, 3012-3014)

(2,2'-Bipyridine Ligandoside: A novel building block for modifying DNA with intra-duplex metal complexes. Weizman, H.; Tor, Y. *J. Am. Chem. Soc.*, 2001, 123, 3375-3376)

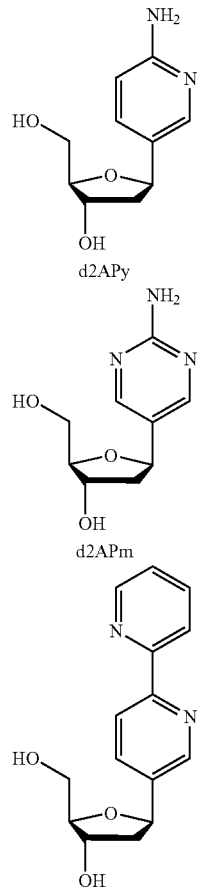

d2APy d2APm (Minor groove hydration is critical to the stability of DNA duplexes. Lan, T.; McLaughlin, L. W. *J. Am. Chem. Soc.*, 2000, 122, 6512-13)

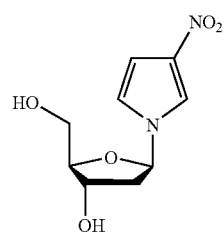

(Effect of the Universal base 3-nitropyrrole on the selectivity of neighboring natural bases. Oliver, J. S.; Parker, K. A.; Suggs, J. W. *Organic Lett.*, 2001, 3, 1977-1980. 2. Effect of the 1-(2'-deoxy-β-D-ribofuranosyl)-3-nitropyrrol residue on the stability of DNA duplexes and triplexes. Amosova, O.; George J.; Fresco, J. R. *Nucleic Acids Res.*, 1997, 25, 1930-1934. 3. Synthesis, structure and deoxyribonucleic acid sequencing with a universal nucleosides: 1-(2'-deoxy-β-D- ribofuranosyl)-3-nitropyrrole. Bergstrom, D. E.; Zhang, P.; Toma, P. H.; Andrews, P. C.; Nichols, R. *J. Am. Chem. Soc.,* 1995, 117, 1201-1209)

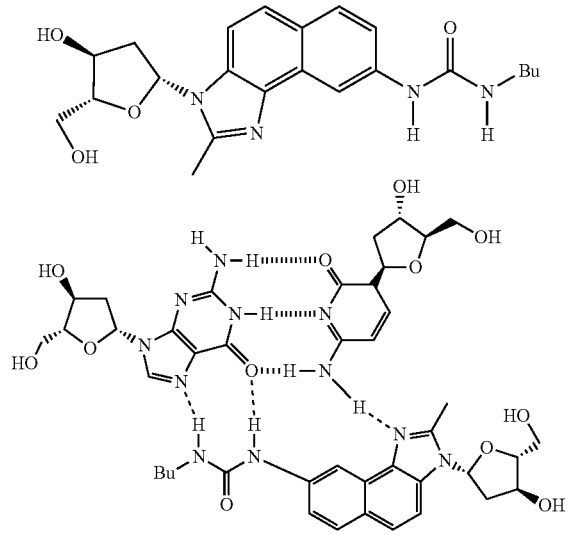

(Model studies directed toward a general triplex DNA recognition scheme: a novel DNA base that binds a CG base-pair in an organic solvent Zimmerman, S. C.; Schmitt, P. *J. Am. Chem. Soc.,* 1995, 117, 10769-10770)

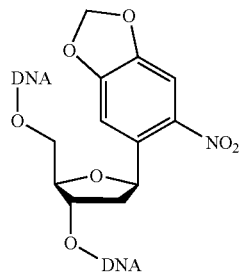

(A universal, photocleavable DNA base: nitropiperonyl 2'-deoxyriboside. *J. Org. Chem.,* 2001, 66, 2067-2071)

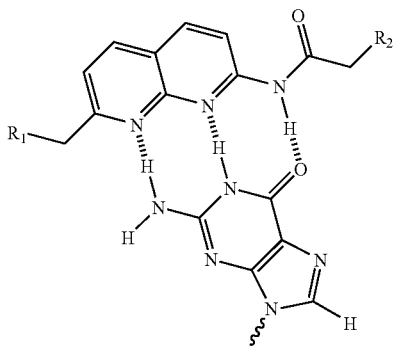

(Recognition of a single guanine bulge by 2-acylamino-1,8-naphthyridine. Nakatani, K.; Sando, S.; Saito, I. *J. Am. Chem. Soc.,* 2000, 122, 2172-2177. b. Specific binding of 2-amino-1,8-naphthyridine into single guanine bulge as evidenced by photooxidation of GC doublet, Nakatani, K.; Sando, S.; Yoshida, K.; Saito, I. *Bioorg. Med. Chem. Lett.,* 2001, 11, 335-337)

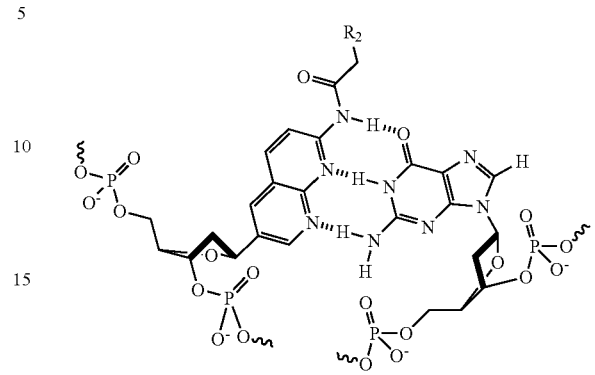

Other universal bases can have the following formulas:

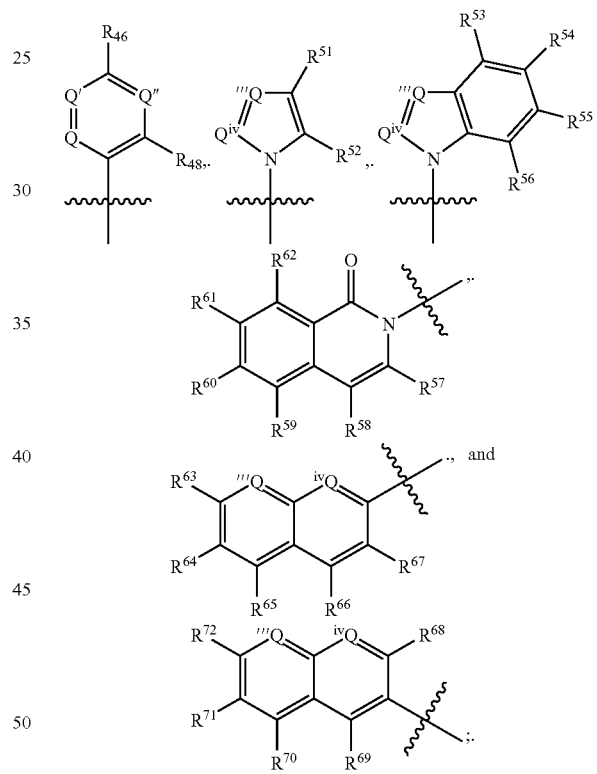

wherein:
Q is N or $CR^{44}$;
Q' is N or $CR^{45}$;
Q" is N or $CR^{47}$;
Q''' is N or $CR^{49}$;
$Q^{iv}$ is N or $CR^{50}$;
$R^{44}$ is hydrogen, halo, hydroxy, nitro, protected hydroxy, $NH_2$, $NHR^b$, or $NR^bR^c$, $C_1$-$C_6$ alkyl, $C_6$-$C_{10}$ aryl, $C_6$-$C_{10}$ heteroaryl, $C_3$-$C_8$ heterocyclyl, or when taken together with $R^{45}$ forms —$OCH_2O$—;
$R^{45}$ is hydrogen, halo, hydroxy, nitro, protected hydroxy, $NH_2$, $NHR^b$, or $NR^bR^c$, $C_1$-$C_6$ alkyl, $C_6$-$C_{10}$ aryl, $C_6$-$C_{10}$ heteroaryl, $C_3$-$C_8$ heterocyclyl, or when taken together with $R^{44}$ or $R^{46}$ forms —$OCH_2O$—;

R⁴⁶ is hydrogen, halo, hydroxy, nitro, protected hydroxy, NH₂, NHR$^b$, or NR$^b$R$^c$C, C₁-C₆ alkyl, C₆-C₁₀ aryl, C₆-C₁₀ heteroaryl, C₃-C₈ heterocyclyl, or when taken together with R⁴⁵ or R⁴⁷ forms —OCH₂O—;

R⁴⁷ is hydrogen, halo, hydroxy, nitro, protected hydroxy, NH₂, NHR$^b$, or NR$^b$R$^c$C, C₁-C₆ alkyl, C₆-C₁₀ aryl, C₆-C₁₀ heteroaryl, C₃-C₈ heterocyclyl, or when taken together with R⁴⁶ or R⁴⁸ forms —OCH2O—;

R⁴⁸ is hydrogen, halo, hydroxy, nitro, protected hydroxy, NH₂, NHR$^b$, or NR$^b$R$^c$C, C₁-C₆ alkyl, C₆-C₁₀ aryl, C₆-C₁₀ heteroaryl, C₃-C₈ heterocyclyl, or when taken together with R⁴⁷ forms —OCH2O—;

R⁴⁹R⁵⁰, R⁵¹, R⁵², R⁵³, R⁵⁴, R⁵⁷, R⁵⁸, R⁵⁹, R⁶⁰, R⁶¹, R⁶², R⁶³, R⁶⁴, R⁶⁵, R⁶⁶, R⁶⁷, R⁶⁸, R⁶⁹R⁷⁰, R⁷¹, and R⁷² are each independently selected from hydrogen, halo, hydroxy, nitro, protected hydroxy, NH₂, NHR$^b$, or NR$^b$R$^c$C, C₁-C₆ alkyl, C₂-C₆ alkynyl, C₆-C₁₀ aryl, C₆-C₁₀ heteroaryl, C₃-C₈ heterocyclyl, NC(O)R¹⁷, or NC(O)R°;

R⁵⁵ is hydrogen, halo, hydroxy, nitro, protected hydroxy, NH₂, NHR$^b$, or NR$^b$R$^c$C, C₁-C₆ alkyl, C₂-C₆ alkynyl, C₆-C₁₀ aryl, C₆-C₁₀ heteroaryl, C₃-C₈ heterocyclyl, NC(O)R¹⁷, or NC(O)R°, or when taken together with R⁵⁶ forms a fused aromatic ring which may be optionally substituted;

R⁵⁶ is hydrogen, halo, hydroxy, nitro, protected hydroxy, NH₂, NHR$^b$, or NR$^b$R$^c$C, C₁-C₆ alkyl, C₂-C₆ alkynyl, C₆-C₁₀ aryl, C₆-C₁₀ heteroaryl, C₃-C₈ heterocyclyl, NC(O)R¹⁷, or NC(O)R°, or when taken together with R⁵⁵ forms a fused aromatic ring which may be optionally substituted;

R¹⁷ is halo, NH₂, NHR$^b$, or NR$^b$R$^c$;

R$^b$ is C₁-C₆ alkyl or a nitrogen protecting group;

R$^c$ is C₁-C₆ alkyl; and

R° is alkyl optionally substituted with halo, hydroxy, nitro, protected hydroxy, NH₂, NHR$^b$, or NR$^b$R$^c$, C₁-C₆ alkyl, C₂-C₆ alkynyl, C₆-C₁₀ aryl, C₆-C₁₀ heteroaryl, C₃-C₈ heterocyclyl, NC(O)R¹⁷, or NC(O)R°.

Examples of universal bases include:

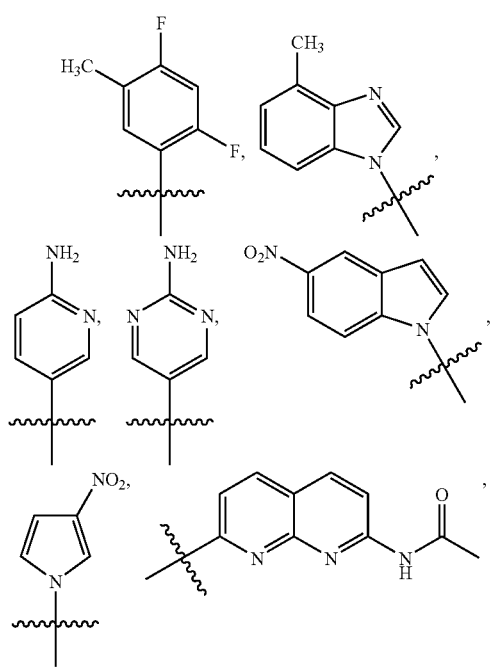

In one aspect, the invention features methods of producing iRNA agents, e.g., sRNA agents, e.g. an sRNA agent described herein, having the ability to mediate RNAi. These iRNA agents can be formulated for administration to a subject.

In another aspect, the invention features a method of administering an iRNA agent, e.g., a double-stranded iRNA agent, or sRNA agent, to a subject (e.g., a human subject). The method includes administering a unit dose of the iRNA agent, e.g., a sRNA agent, e.g., double stranded sRNA agent that (a) the double-stranded part is 19-25 nucleotides (nt) long, preferably 21-23 nt, (b) is complementary to a target RNA (e.g., an endogenous or pathogen target RNA), and, optionally, (c) includes at least one 3' overhang 1-5 nucleotide long. In one embodiment, the unit dose is less than 1.4 mg per kg of bodyweight, or less than 10, 5, 2, 1, 0.5, 0.1, 0.05, 0.01, 0.005, 0.001, 0.0005, 0.0001, 0.00005 or 0.00001 mg per kg of bodyweight, and less than 200 mmole of RNA agent (e.g. about $4.4 \times 10^{16}$ copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmole of RNA agent per kg of bodyweight.

The defined amount can be an amount effective to treat or prevent a disease or disorder, e.g., a disease or disorder associated with the target RNA. The unit dose, for example, can be administered by injection (e.g., intravenous or intramuscular), an inhaled dose, or a topical application. Particularly preferred dosages are less than 2, 1, or 0.1 mg/kg of body weight.

In a preferred embodiment, the unit dose is administered less frequently than once a day, e.g., less than every 2, 4, 8 or 30 days. In another embodiment, the unit dose is not administered with a frequency (e.g., not a regular frequency). For example, the unit dose may be administered a single time.

In one embodiment, the effective dose is administered with other traditional therapeutic modalities. In one embodiment, the subject has a viral infection and the modality is an antiviral agent other than an iRNA agent, e.g., other than a double-stranded iRNA agent, or sRNA agent. In another embodiment, the subject has atherosclerosis and the effective dose of an iRNA agent, e.g., a double-stranded iRNA agent, or sRNA agent, is administered in combination with, e.g., after surgical intervention, e.g., angioplasty.

In one embodiment, a subject is administered an initial dose and one or more maintenance doses of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof). The maintenance dose or doses are generally lower than the initial dose, e.g., one-half less of the initial dose. A maintenance regimen can include treating the subject with a dose or doses ranging from 0.01 μg to 1.4 mg/kg of body weight per day, e.g., 10, 1, 0.1, 0.01, 0.001, or 0.00001 mg per kg of bodyweight per day. The maintenance doses are preferably administered no more than once every 5, 10, or 30 days.

In one embodiment, the iRNA agent pharmaceutical composition includes a plurality of iRNA agent species. In another embodiment, the iRNA agent species has sequences that are non-overlapping and non-adjacent to another species with respect to a naturally occurring target sequence. In another embodiment, the plurality of iRNA agent species is specific for different naturally occurring target genes. In another embodiment, the iRNA agent is allele specific.

The inventors have discovered that iRNA agents described herein can be administered to mammals, particularly large mammals such as nonhuman primates or humans in a number of ways.

In one embodiment, the administration of the iRNA agent, e.g., a double-stranded iRNA agent, or sRNA agent, composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The medication can be provided in measured doses or in a dispenser that delivers a metered dose. Selected modes of delivery are discussed in more detail below.

The invention provides methods, compositions, and kits, for rectal administration or delivery of iRNA agents described herein.

Accordingly, an iRNA agent, e.g., a double-stranded iRNA agent, or sRNA agent, (e.g., a precursor, e.g., a larger iRNA agent which can be processed into a sRNA agent, or a DNA which encodes a an iRNA agent, e.g., a double-stranded iRNA agent, or sRNA agent, or precursor thereof) described herein, e.g., a therapeutically effective amount of a iRNA agent described herein, e.g., a iRNA agent having a double stranded region of less than 40, and preferably less than 30 nucleotides and having one or two 1-3 nucleotide single strand 3' overhangs can be administered rectally, e.g., introduced through the rectum into the lower or upper colon. This approach is particularly useful in the treatment of, inflammatory disorders, disorders characterized by unwanted cell proliferation, e.g., polyps, or colon cancer.

In some embodiments the medication is delivered to a site in the colon by introducing a dispensing device, e.g., a flexible, camera-guided device similar to that used for inspection of the colon or removal of polyps, which includes means for delivery of the medication.

In one embodiment, the rectal administration of the iRNA agent is by means of an enema. The iRNA agent of the enema can be dissolved in a saline or buffered solution.

In another embodiment, the rectal administration is by means of a suppository. The suppository can include other ingredients, e.g., an excipient, e.g., cocoa butter or hydropropylmethylcellulose.

The invention also provides methods, compositions, and kits for oral delivery of iRNA agents described herein.

Accordingly, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein, e.g., a therapeutically effective amount of a iRNA described herein, e.g., a iRNA agent having a double stranded region of less than 40 and preferably less than 30 nucleotides and having one or two 1-3 nucleotide single strand 3' overhangs can be administered orally.

Oral administration can be in the form of tablets, capsules, gel capsules, lozenges, troches or liquid syrups. In a preferred embodiment the composition is applied topically to a surface of the oral cavity.

The invention also provides methods, compositions, and kits for buccal delivery of iRNA agents described herein.

Accordingly, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein, e.g., a therapeutically effective amount of iRNA agent having a double stranded region of less than 40 and preferably less than 30 nucleotides and having one or two 1-3 nucleotide single strand 3' overhangs can be administered to the buccal cavity. The medication can be sprayed into the buccal cavity or applied directly, e.g., in a liquid, solid, or gel form to a surface in the buccal cavity. This administration is particularly desirable for the treatment of inflammations of the buccal cavity, e.g., the gums or tongue, e.g., in one embodiment, the buccal administration is by spraying into the cavity, e.g., without inhalation, from a dispenser, e.g., a metered dose spray dispenser that dispenses the pharmaceutical composition and a propellant.

The invention also provides methods, compositions, and kits for ocular delivery of iRNA agents described herein.

Accordingly, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein, e.g., a therapeutically effective amount of a iRNA agent described herein, e.g., a sRNA agent having a double stranded region of less than 40 and preferably less than 30 nucleotides and having one or two 1-3 nucleotide single strand 3' overhangs can be administered to ocular tissue.

The medications can be applied to the surface of the eye or nearby tissue, e.g., the inside of the eyelid. It can be applied topically, e.g., by spraying, in drops, as an eyewash, or an ointment. Administration can be provided by the subject or by another person, e.g., a health care provider. The medication can be provided in measured doses or in a dispenser that delivers a metered dose.

The medication can also be administered to the interior of the eye, and can be introduced by a needle or other delivery device which can introduce it to a selected area or structure.

Ocular treatment is particularly desirable for treating inflammation of the eye or nearby tissue.

The invention also provides methods, compositions, and kits for delivery of iRNA agents described herein to or through the skin.

Accordingly, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein, e.g., a therapeutically effective amount of a iRNA agent described herein, e.g., a sRNA agent having a double stranded region of less than 40 and preferably less than 30 nucleotides and one or two 1-3 nucleotide single strand 3' overhangs can be administered directly to the skin.

The medication can be applied topically or delivered in a layer of the skin, e.g., by the use of a microneedle or a battery of microneedles which penetrate into the skin, but preferably not into the underlying muscle tissue.

In one embodiment, the administration of the iRNA agent composition is topical. In another embodiment, topical administration delivers the composition to the dermis or epidermis of a subject. In other embodiments the topical administration is in the form of transdermal patches, ointments, lotions, creams, gels, drops, suppositories, sprays, liquids or powders. A composition for topical administration can be formulated as a liposome, micelle, emulsion, or other lipophilic molecular assembly.

In another embodiment, the transdermal administration is applied with at least one penetration enhancer. In other embodiments, the penetration can be enhanced with iontophoresis, phonophoresis, and sonophoresis. In another aspect, the invention provides methods, compositions, devices, and kits for pulmonary delivery of iRNA agents described herein.

Accordingly, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein, e.g., a therapeutically effective amount of iRNA agent, e.g., a sRNA agent having a double stranded region of less than 40, preferably less than 30 nucleotides and having one or two 1-3 nucleotide single strand 3' overhangs can be administered to the pulmonary system. Pulmonary administration can be achieved by inhalation or by the introduction of a delivery device into the pulmonary system, e.g., by introducing a delivery device which can dispense the medication.

The preferred method of pulmonary delivery is by inhalation. The medication can be provided in a dispenser which delivers the medication, e.g., wet or dry, in a form sufficiently small such that it can be inhaled. The device can deliver a metered dose of medication. The subject, or another person, can administer the medication.

Pulmonary delivery is effective not only for disorders which directly affect pulmonary tissue, but also for disorders which affect other tissue.

iRNA agents can be formulated as a liquid or nonliquid, e.g., a powder, crystal, or aerosol for pulmonary delivery.

In another aspect, the invention provides methods, compositions, devices, and kits for nasal delivery of iRNA agents described herein. Accordingly, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein, e.g., a therapeutically effective amount of iRNA agent, e.g., a sRNA agent having a double stranded region of less than 40 and preferably less than 30 nucleotides and having one or two 1-3 nucleotide single strand 3' overhangs can be administered nasally. Nasal administration can be achieved by introduction of a delivery device into the nose, e.g., by introducing a delivery device which can dispense the medication.

The preferred method of nasal delivery is by spray, aerosol, liquid, e.g., by drops, of by topical administration to a surface of the nasal cavity. The medication can be provided in a dispenser which delivery of the medication, e.g., wet or dry, in a form sufficiently small such that it can be inhaled. The device can deliver a metered dose of medication. The subject, or another person, can administer the medication.

Nasal delivery is effective not only for disorders which directly affect nasal tissue, but also for disorders which affect other tissue iRNA agents can be formulated as a liquid or nonliquid, e.g., a powder, crystal, or for nasal delivery.

In another embodiment, the iRNA agent is packaged in a viral natural capsid or in a chemically or enzymatically produced artificial capsid or structure derived therefrom.

In one aspect, of the invention, the dosage of a pharmaceutical composition including a iRNA agent is administered in order to alleviate the symptoms of a disease state, e.g., cancer or a cardiovascular disease.

In another aspect, gene expression in a subject is modulated by administering a pharmaceutical composition including a iRNA agent. In other embodiments, a subject is treated with the pharmaceutical composition by any of the methods mentioned above. In another embodiment, the subject has cancer.

An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) composition can be administered as a liposome. For example, the composition can be prepared by a method that includes: (1) contacting a iRNA agent with an amphipathic cationic lipid conjugate in the presence of a detergent; and (2) removing the detergent to form a iRNA agent and cationic lipid complex. In one embodiment, the detergent is cholate, deoxycholate, lauryl sarcosine, octanoyl sucrose, CHAPS (3-[(3-cholamidopropyl)-di-methylamine]-2-hydroxyl-1-propane), novel-β-D-glucopyranoside, lauryl dimethylamine oxide, or octylglucoside. The iRNA agent can be an sRNA agent. The method can include preparing a composition that includes a plurality of iRNA agents, e.g., specific for one or more different endogenous target RNAs. The method can include other features described herein.

In another aspect, a subject is treated by administering a defined amount of an iRNA agent, e.g., a double-stranded iRNA agent, or sRNA agent, (e.g., a precursor, e.g., a larger iRNA agent which can be processed into a sRNA agent) composition that is in a powdered form. In one embodiment, the powder is a collection of microparticles. In one embodiment, the powder is a collection of crystalline particles. The composition can include a plurality of iRNA agents, e.g., specific for one or more different endogenous target RNAs. The method can include other features described herein.

In one aspect, a subject is treated by administering a defined amount of a iRNA agent composition that is prepared by a method that includes spray-drying, i.e. atomizing a liquid solution, emulsion, or suspension, immediately exposing the droplets to a drying gas, and collecting the resulting porous powder particles. The composition can include a plurality of iRNA agents, e.g., specific for one or more different endogenous target RNAs. The method can include other features described herein.

In one aspect, the iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), is provided in a powdered, crystallized or other finely divided form, with or without a carrier, e.g., a micro- or nano-particle suitable for inhalation or other pulmonary delivery. In one embodiment, this includes providing an aerosol preparation, e.g., an aerosolized spray-dried composition. The aerosol composition can be provided in and/or dispensed by a metered dose delivery device.

In another aspect, a subject is treated for a condition treatable by inhalation. In one embodiment, this method includes aerosolizing a spray-dried iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) composition and inhaling the aerosolized composition. The iRNA agent can be an sRNA. The composition can include a plurality of iRNA agents, e.g., specific for one or more different endogenous target RNAs. The method can include other features described herein.

In another aspect, the invention features a method of treating a subject that includes: administering a composition including an effective/defined amount of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), wherein the composition is prepared by a method that includes spray-drying, lyophilization, vacuum drying, evaporation, fluid bed drying, or a combination of these techniques In another aspect, the invention features a method that includes: evaluating a parameter related to the abundance of a transcript in a cell of a subject; comparing the evaluated parameter to a reference value; and if the evaluated parameter has a preselected relationship to the reference value (e.g., it is greater), administering a iRNA agent (or a precursor, e.g., a larger iRNA agent which can be processed into a sRNA agent, or a DNA which encodes a iRNA agent or precursor thereof) to the subject. In one embodiment, the iRNA agent includes a sequence that is complementary to the evaluated transcript. For example, the parameter can be a direct measure of transcript levels, a measure of a protein level, a disease or disorder symptom or characterization (e.g., rate of cell proliferation and/or tumor mass, viral load,)

In another aspect, the invention features a method that includes: administering a first amount of a composition that comprises an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) to a subject, wherein the iRNA agent includes a strand substantially complementary to a target nucleic acid; evaluating an activity associated with a protein encoded by the target nucleic acid; wherein the evaluation is used to determine if a second amount should be administered. In a preferred embodiment the method includes administering a second amount of the composition, wherein the timing of administration or dosage of the second amount is a function of the evaluating. The method can include other features described herein.

In another aspect, the invention features a method of administering a source of a double-stranded iRNA agent (ds iRNA agent) to a subject. The method includes administering or implanting a source of a ds iRNA agent, e.g., a sRNA agent, that (a) includes a double-stranded region that is 19-25 nucleotides long, preferably 21-23 nucleotides, (b) is complementary to a target RNA (e.g., an endogenous RNA or a pathogen RNA), and, optionally, (c) includes at least one 3' overhang 1-5 nt long. In one embodiment, the source releases ds iRNA agent over time, e.g. the source is a controlled or a slow release source, e.g., a microparticle that gradually releases the ds iRNA agent. In another embodiment, the source is a pump, e.g., a pump that includes a sensor or a pump that can release one or more unit doses.

In one aspect, the invention features a pharmaceutical composition that includes an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) including a nucleotide sequence complementary to a target RNA, e.g., substantially and/or exactly complementary. The target RNA can be a transcript of an endogenous human gene. In one embodiment, the iRNA agent (a) is 19-25 nucleotides long, preferably 21-23 nucleotides, (b) is complementary to an endogenous target RNA, and, optionally, (c) includes at least one 3' overhang 1-5 nt long. In one embodiment, the pharmaceutical composition can be an emulsion, microemulsion, cream, jelly, or liposome.

In one example the pharmaceutical composition includes an iRNA agent mixed with a topical delivery agent. The topical delivery agent can be a plurality of microscopic vesicles. The microscopic vesicles can be liposomes. In a preferred embodiment the liposomes are cationic liposomes.

In another aspect, the pharmaceutical composition includes an iRNA agent, e.g., a double-stranded iRNA agent, or sRNA agent (e.g., a precursor, e.g., a larger iRNA agent which can be processed into a sRNA agent, or a DNA which encodes an iRNA agent, e.g., a double-stranded iRNA agent, or sRNA agent, or precursor thereof) admixed with a topical penetration enhancer. In one embodiment, the topical penetration enhancer is a fatty acid. The fatty acid can be arachidonic acid, oleic acid, lauric acid, caprylic acid, capric acid, myristic acid, palmitic acid, stearic acid, linoleic acid, linolenic acid, dicaprate, tricaprate, monolein, dilaurin, glyceryl 1-monocaprate, 1-dodecylazacycloheptan-2-one, an acylcarnitine, an acylcholine, or a $C_{1-10}$ alkyl ester, monoglyceride, diglyceride or pharmaceutically acceptable salt thereof.

In another embodiment, the topical penetration enhancer is a bile salt. The bile salt can be cholic acid, dehydrocholic acid, deoxycholic acid, glucholic acid, glycholic acid, glycodeoxycholic acid, taurocholic acid, taurodeoxycholic acid, chenodeoxycholic acid, ursodeoxycholic acid, sodium tauro-24,25-dihydro-fusidate, sodium glycodihydrofusidate, polyoxyethylene-9-lauryl ether or a pharmaceutically acceptable salt thereof.

In another embodiment, the penetration enhancer is a chelating agent. The chelating agent can be EDTA, citric acid, a salicyclate, a N-acyl derivative of collagen, laureth-9, an N-amino acyl derivative of a beta-diketone or a mixture thereof.

In another embodiment, the penetration enhancer is a surfactant, e.g., an ionic or nonionic surfactant. The surfactant can be sodium lauryl sulfate, polyoxyethylene-9-lauryl ether, polyoxyethylene-20-cetyl ether, a perfluorchemical emulsion or mixture thereof.

In another embodiment, the penetration enhancer can be selected from a group consisting of unsaturated cyclic ureas, 1-alkyl-alkones, 1-alkenylazacyclo-alakanones, steroidal anti-inflammatory agents and mixtures thereof. In yet another embodiment the penetration enhancer can be a glycol, a pyrrol, an azone, or a terpenes.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a form suitable for oral delivery. In one embodiment, oral delivery can be used to deliver an iRNA agent composition to a cell or a region of the gastro-intestinal tract, e.g., small intestine, colon (e.g., to treat a colon cancer), and so forth. The oral delivery form can be tablets, capsules or gel capsules. In one embodiment, the iRNA agent of the pharmaceutical composition modulates expression of a cellular adhesion protein, modulates a rate of cellular proliferation, or has biological activity against eukaryotic pathogens or retroviruses. In another embodiment, the pharmaceutical composition includes an enteric material that substantially prevents dissolution of the tablets, capsules or gel capsules in a mammalian stomach. In a preferred embodiment the enteric material is a coating. The coating can be acetate phthalate, propylene glycol, sorbitan monoleate, cellulose acetate trimellitate, hydroxy propyl methylcellulose phthalate or cellulose acetate phthalate.

In another embodiment, the oral dosage form of the pharmaceutical composition includes a penetration enhancer. The penetration enhancer can be a bile salt or a fatty acid. The bile salt can be ursodeoxycholic acid, chenodeoxycholic acid, and salts thereof. The fatty acid can be capric acid, lauric acid, and salts thereof.

In another embodiment, the oral dosage form of the pharmaceutical composition includes an excipient. In one example the excipient is polyethyleneglycol. In another example the excipient is precirol.

In another embodiment, the oral dosage form of the pharmaceutical composition includes a plasticizer. The plasticizer can be diethyl phthalate, triacetin dibutyl sebacate, dibutyl phthalate or triethyl citrate.

In one aspect, the invention features a pharmaceutical composition including an iRNA agent and a delivery vehicle. In one embodiment, the iRNA agent is (a) is 19-25 nucleotides long, preferably 21-23 nucleotides, (b) is complementary to an endogenous target RNA, and, optionally, (c) includes at least one 3' overhang 1-5 nucleotides long.

In one embodiment, the delivery vehicle can deliver an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) to a cell by a topical route of administration. The delivery vehicle can be microscopic vesicles. In one example the microscopic vesicles are liposomes. In a preferred embodiment the liposomes are cationic liposomes. In another example the microscopic vesicles are micelles.

In one aspect, the invention features a method for making a pharmaceutical composition, the method including: (1) contacting an iRNA agent, e.g., a double-stranded iRNA agent, or sRNA agent, (e.g., a precursor, e.g., a larger iRNA agent which can be processed into a sRNA agent) with a amphipathic cationic lipid conjugate in the presence of a detergent; and (2) removing the detergent to form a iRNA agent and cationic lipid complex.

In another aspect, the invention features a pharmaceutical composition produced by a method including: (1) contacting an iRNA agent, e.g., a double-stranded iRNA agent, or sRNA agent, (e.g., a precursor, e.g., a larger iRNA agent which can be processed into a sRNA agent) with a amphipathic cationic lipid conjugate in the presence of a detergent; and (2) removing the detergent to form a iRNA agent and cationic lipid complex. In one embodiment, the detergent is cholate, deoxycholate, lauryl sarcosine, octanoyl sucrose, CHAPS (3-[(3-cholamidopropyl)-di-methylamine]-2-hydroxyl-1-propane), novel-β-D-glucopyranoside, lauryl dimethylamine oxide, or octylglucoside. In another embodiment, the amphipathic cationic lipid conjugate is biodegradable. In yet another embodiment the pharmaceutical composition includes a targeting ligand.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in an injectable dosage form. In one embodiment, the injectable dosage form of the pharmaceutical composition includes sterile aqueous solutions or dispersions and sterile powders. In a preferred embodiment the sterile solution can include a diluent such as water; saline solution; fixed oils, polyethylene glycols, glycerin, or propylene glycol.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in oral dosage form. In one embodiment, the oral dosage form is selected from the group consisting of tablets, capsules and gel capsules. In another embodiment, the pharmaceutical composition includes an enteric material that substantially prevents dissolution of the tablets, capsules or gel capsules in a mammalian stomach. In a preferred embodiment the enteric material is a coating. The coating can be acetate phthalate, propylene glycol, sorbitan monoleate, cellulose acetate trimellitate, hydroxy propyl methyl cellulose phthalate or cellulose acetate phthalate. In one embodiment, the oral dosage form of the pharmaceutical composition includes a penetration enhancer, e.g., a penetration enhancer described herein.

In another embodiment, the oral dosage form of the pharmaceutical composition includes an excipient. In one example the excipient is polyethyleneglycol. In another example the excipient is precirol.

In another embodiment, the oral dosage form of the pharmaceutical composition includes a plasticizer. The plasticizer can be diethyl phthalate, triacetin dibutyl sebacate, dibutyl phthalate or triethyl citrate.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a rectal dosage form. In one embodiment, the rectal dosage form is an enema. In another embodiment, the rectal dosage form is a suppository.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a vaginal dosage form. In one embodiment, the vaginal dosage form is a suppository. In another embodiment, the vaginal dosage form is a foam, cream, or gel.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a pulmonary or nasal dosage form. In one embodiment, the iRNA agent is incorporated into a particle, e.g., a macroparticle, e.g., a microsphere. The particle can be produced by spray drying, lyophilization, evaporation, fluid bed drying, vacuum drying, or a combination thereof. The microsphere can be formulated as a suspension, a powder, or an implantable solid.

In one aspect, the invention features a spray-dried iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) composition suitable for inhalation by a subject, including: (a) a therapeutically effective amount of a iRNA agent suitable for treating a condition in the subject by inhalation; (b) a pharmaceutically acceptable excipient selected from the group consisting of carbohydrates and amino acids; and (c) optionally, a dispersibility-enhancing amount of a physiologically-acceptable, water-soluble polypeptide.

In one embodiment, the excipient is a carbohydrate. The carbohydrate can be selected from the group consisting of monosaccharides, disaccharides, trisaccharides, and polysaccharides. In a preferred embodiment the carbohydrate is a monosaccharide selected from the group consisting of dextrose, galactose, mannitol, D-mannose, sorbitol, and sorbose.

In another preferred embodiment the carbohydrate is a disaccharide selected from the group consisting of lactose, maltose, sucrose, and trehalose.

In another embodiment, the excipient is an amino acid. In one embodiment, the amino acid is a hydrophobic amino acid. In a preferred embodiment the hydrophobic amino acid is selected from the group consisting of alanine, isoleucine, leucine, methionine, phenylalanine, proline, tryptophan, and valine. In yet another embodiment the amino acid is a polar amino acid. In a preferred embodiment the amino acid is selected from the group consisting of arginine, histidine, lysine, cysteine, glycine, glutamine, serine, threonine, tyrosine, aspartic acid and glutamic acid.

In one embodiment, the dispersibility-enhancing polypeptide is selected from the group consisting of human serum albumin, α-lactalbumin, trypsinogen, and polyalanine.

In one embodiment, the spray-dried iRNA agent composition includes particles having a mass median diameter (MMD) of less than 10 microns. In another embodiment, the spray-dried iRNA agent composition includes particles having a mass median diameter of less than 5 microns. In yet another embodiment the spray-dried iRNA agent composition includes particles having a mass median aerodynamic diameter (WAD) of less than 5 microns.

In certain other aspects, the invention provides kits that include a suitable container containing a pharmaceutical formulation of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof). In certain embodiments the individual components of the pharmaceutical formulation may be provided in one container. Alternatively, it may be desirable to provide the components of the pharmaceutical formulation separately in two or more containers, e.g., one container for an iRNA agent preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

In another aspect, the invention features a device, e.g., an implantable device, wherein the device can dispense or administer a composition that includes an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), e.g., a iRNA agent that silences an endogenous transcript. In one embodiment, the device is coated with the composition. In another embodiment the iRNA agent is disposed within the device. In another embodiment, the device includes a mechanism to dispense a unit dose of the composition. In other embodiments the device releases the composition continuously, e.g., by diffusion. Exemplary devices include stents, catheters, pumps, artificial organs or organ components (e.g., artificial heart, a heart valve, etc.), and sutures.

As used herein, the term "crystalline" describes a solid having the structure or characteristics of a crystal, i.e., particles of three-dimensional structure in which the plane faces intersect at definite angles and in which there is a regular internal structure. The compositions of the invention may have different crystalline forms. Crystalline forms can be prepared by a variety of methods, including, for example, spray drying.

As used herein, "specifically hybridizable" and "complementary" are terms which are used to indicate a sufficient degree of complementarity such that stable and specific binding occurs between a compound of the invention and a target RNA molecule. Specific binding requires a sufficient degree of complementarity to avoid non-specific binding of the oligomeric compound to non-target sequences under conditions in which specific binding is desired, i.e., under physiological conditions in the case of in vivo assays or therapeutic treatment, or in the case of in vitro assays, under conditions in which the assays are performed. The non-target sequences typically differ by at least 5 nucleotides.

In one embodiment, an iRNA agent is "sufficiently complementary" to a target RNA, e.g., a target mRNA, such that the iRNA agent silences production of protein encoded by the target mRNA. In another embodiment, the iRNA agent is "exactly complementary" to a target RNA, e.g., the target RNA and the iRNA agent anneal, preferably to form a hybrid made exclusively of Watson-Crick basepairs in the region of exact complementarity. A "sufficiently complementary" target RNA can include an internal region (e.g., of at least 10 nucleotides) that is exactly complementary to a target RNA. Moreover, in some embodiments, the iRNA agent specifically discriminates a single-nucleotide difference. In this case, the iRNA agent only mediates RNAi if exact complementary is found in the region (e.g., within 7 nucleotides of) the single-nucleotide difference.

As used herein, the term "oligonucleotide" refers to a nucleic acid molecule (RNA or DNA) preferably of length less than 100, 200, 300, or 400 nucleotides.

Unless otherwise defined, all technical and scientific terms used herein have the same meaning as commonly understood by one of ordinary skill in the art to which this invention pertains. The materials, methods, and examples are illustrative only and not intended to be limiting. Although methods and materials similar or equivalent to those described herein can be used in the practice or testing of the present invention, useful methods and materials are described below. Other features and advantages of the invention will be apparent from the accompanying drawings and description, and from the claims. The contents of all references, pending patent applications and published patents, cited throughout this application are hereby expressly incorporated by reference. In case of conflict, the present specification, including definitions, will control.

DETAILED DESCRIPTION

Figure 1:
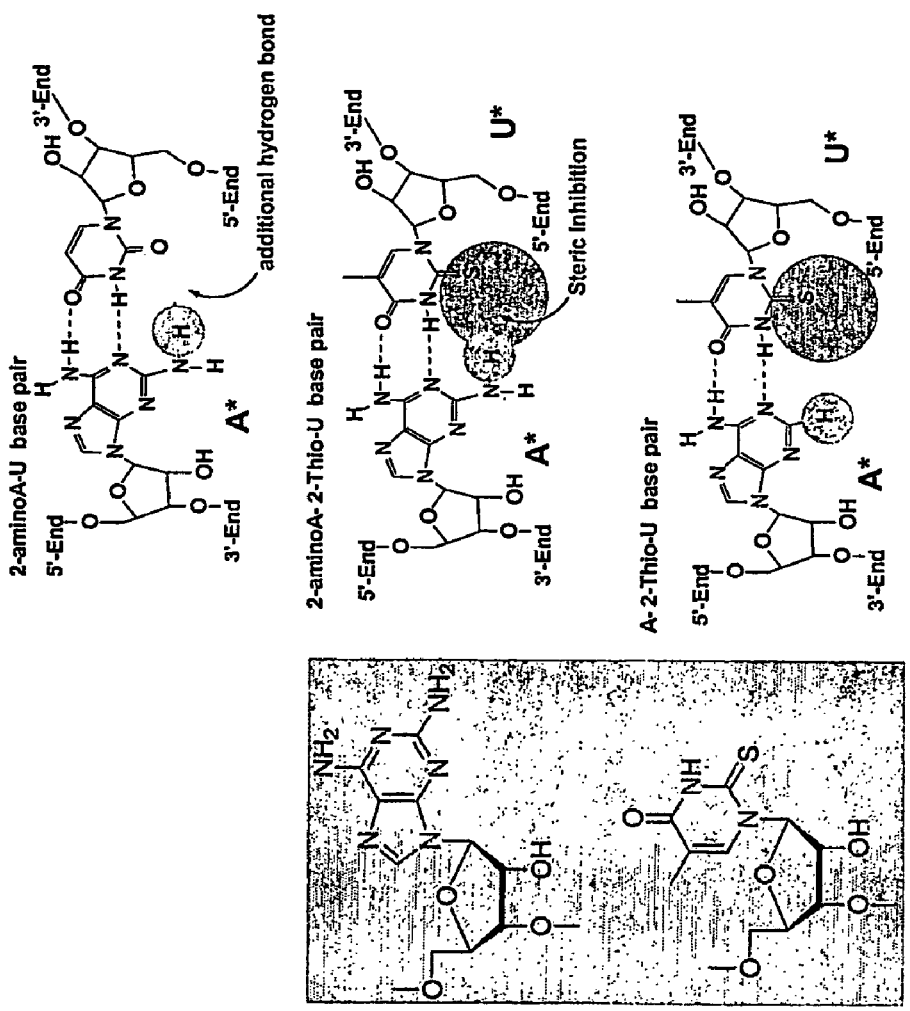
FIG. 1 is a structural representation of base pairing in psuedocomplementary siRNA[2].
Figure 2:
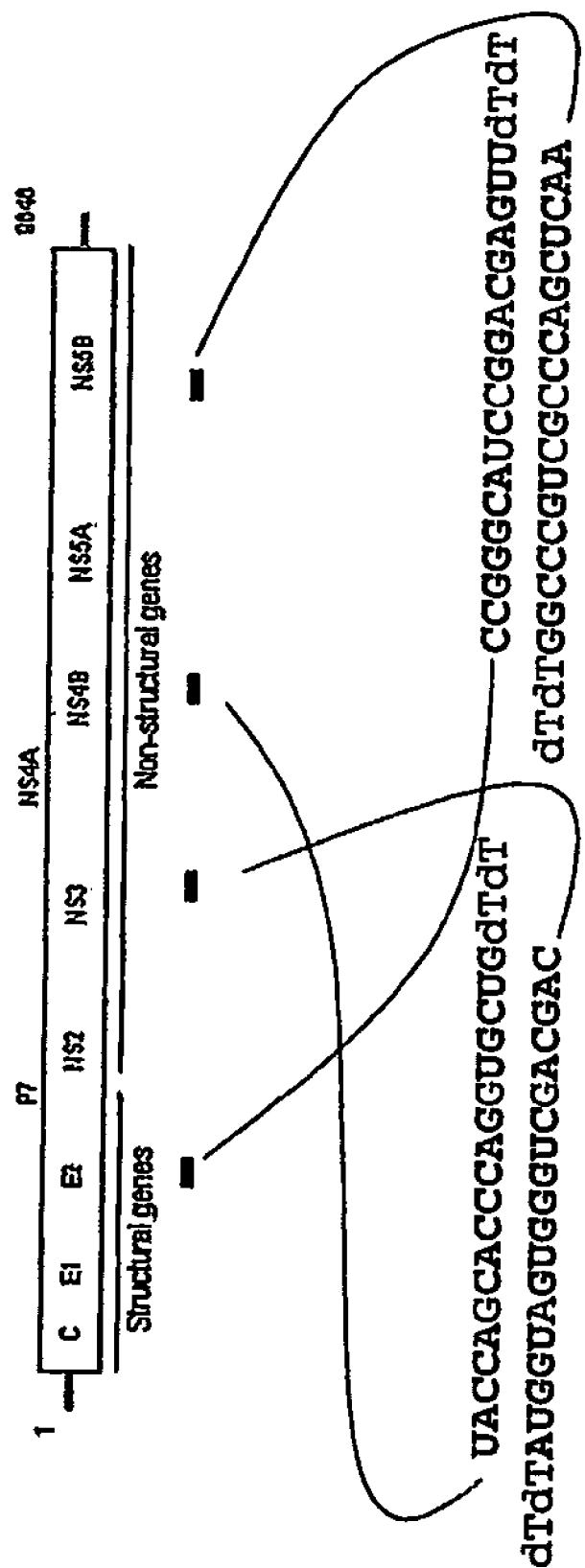
FIG. 2 is a schematic representation of dual targeting siRNAs (SEQ ID NOs 3952, 3953, 3954, and 3955 respectively) designed to target the HCV genome.
Figure 3:
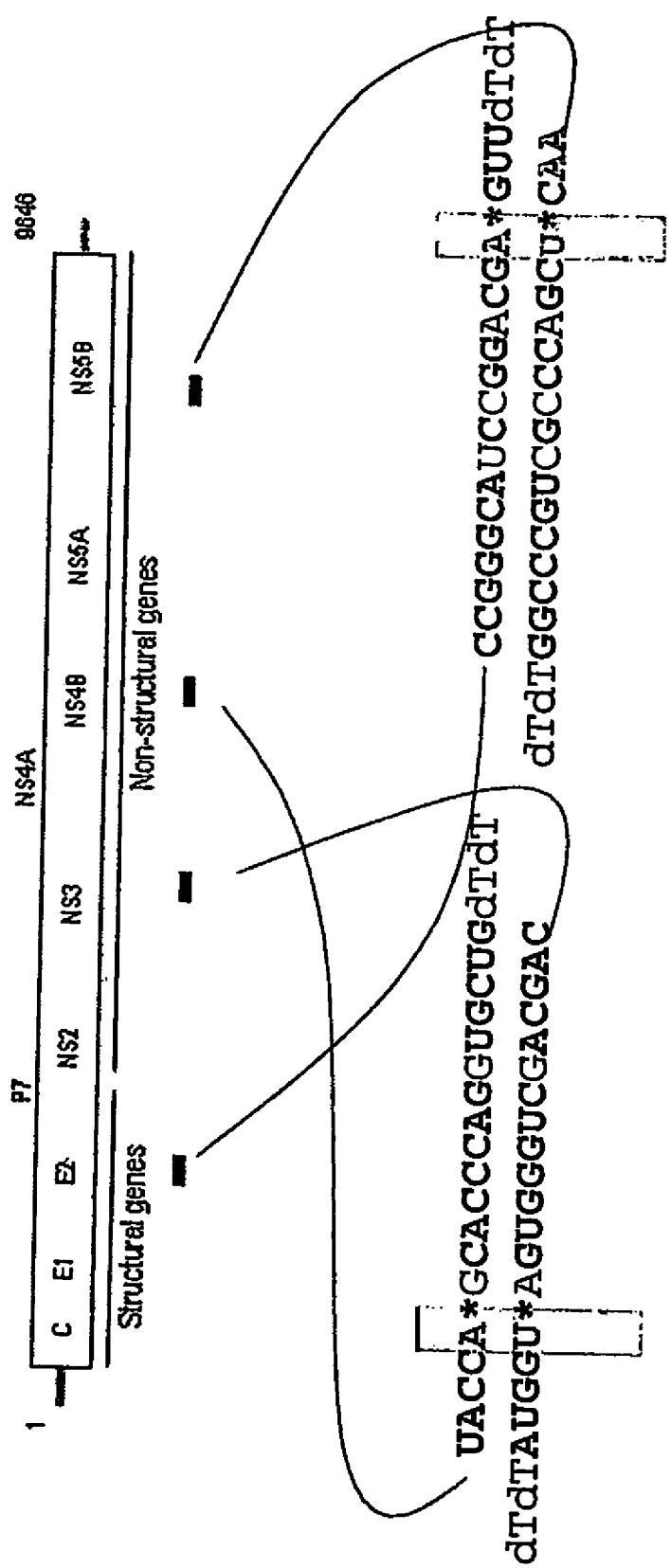
FIG. 3 is a schematic representation of pseudocomplementary, bifunctional siRNAs (SEQ ID NOs 3956, 3957, 3958, and 4087 respectively) designed to target the HCV genome.

Double-stranded (dsRNA) directs the sequence-specific silencing of mRNA through a process known as RNA interference (RNAi). The process occurs in a wide variety of organisms, including mammals and other vertebrates.

It has been demonstrated that 21-23 nt fragments of dsRNA are sequence-specific mediators of RNA silencing, e.g., by causing RNA degradation. While not wishing to be bound by theory, it may be that a molecular signal, which may be merely the specific length of the fragments, present in these 21-23 nt fragments recruits cellular factors that mediate RNAi. Described herein are methods for preparing and administering these 21-23 nt fragments, and other iRNAs agents, and their use for specifically inactivating gene function. The use of iRNAs agents (or recombinantly produced or chemically synthesized oligonucleotides of the same or similar nature) enables the targeting of specific mRNAs for silencing in mammalian cells. In addition, longer dsRNA agent fragments can also be used, e.g., as described below.

Although, in mammalian cells, long dsRNAs can induce the interferon response which is frequently deleterious, sRNAs do not trigger the interferon response, at least not to an extent that is deleterious to the cell and host. In particular, the length of the iRNA agent strands in an sRNA agent can be less than 31, 30, 28, 25, or 23 nt, e.g., sufficiently short to avoid inducing a deleterious interferon response. Thus, the administration of a composition of sRNA agent (e.g., formulated as described herein) to a mammalian cell can be used to silence expression of a target gene while circumventing the interferon response. Further, use of a discrete species of iRNA agent can be used to selectively target one allele of a target gene, e.g., in a subject heterozygous for the allele.

Moreover, in one embodiment, a mammalian cell is treated with an iRNA agent that disrupts a component of the interferon response, e.g., double stranded RNA (dsRNA)-activated protein kinase PKR. Such a cell can be treated with a second iRNA agent that includes a sequence complementary to a target RNA and that has a length that might otherwise trigger the interferon response.

In a typical embodiment, the subject is a mammal such as a cow, horse, mouse, rat, dog, pig, goat, or a primate. The subject can be a dairy mammal (e.g., a cow, or goat) or other farmed animal (e.g., a chicken, turkey, sheep, pig, fish, shrimp). In a much preferred embodiment, the subject is a human, e.g., a normal individual or an individual that has, is diagnosed with, or is predicted to have a disease or disorder.

Further, because iRNA agent mediated silencing persists for several days after administering the iRNA agent composition, in many instances, it is possible to administer the composition with a frequency of less than once per day, or, for some instances, only once for the entire therapeutic regimen. For example, treatment of some cancer cells may be mediated by a single bolus administration, whereas a chronic viral infection may require regular administration, e.g., once per week or once per month.

A number of exemplary routes of delivery are described that can be used to administer an iRNA agent to a subject. In addition, the iRNA agent can be formulated according to an exemplary method described herein.

iRNA Agent Structure

Described herein are isolated iRNA agents, e.g., RNA molecules, (double-stranded; single-stranded) that mediate RNAi. The iRNA agents preferably mediate RNAi with respect to an endogenous gene of a subject or to a gene of a pathogen.

An "RNA agent" as used herein, is an unmodified RNA, modified RNA, or nucleoside surrogate, all of which are defined herein (see, e.g., the section below entitled RNA Agents). While numerous modified RNAs and nucleoside surrogates are described, preferred examples include those which have greater resistance to nuclease degradation than do unmodified RNAs. Preferred examples include those which have a 2' sugar modification, a modification in a single strand overhang, preferably a 3' single strand overhang, or, particularly if single stranded, a 5' modification which includes one or more phosphate groups or one or more analogs of a phosphate group.

An "iRNA agent" as used herein, is an RNA agent which can, or which can be cleaved into an RNA agent which can, down regulate the expression of a target gene, preferably an endogenous or pathogen target RNA. While not wishing to be bound by theory, an iRNA agent may act by one or more of a number of mechanisms, including post-transcriptional cleavage of a target mRNA sometimes referred to in the art as RNAi, or pre-transcriptional or pre-translational mechanisms. An iRNA agent can include a single strand or can include more than one strands, e.g., it can be a double stranded iRNA agent. If the iRNA agent is a single strand it is particularly preferred that it include a 5' modification which includes one or more phosphate groups or one or more analogs of a phosphate group.

The iRNA agent should include a region of sufficient homology to the target gene, and be of sufficient length in terms of nucleotides, such that the iRNA agent, or a fragment thereof, can mediate down regulation of the target gene. (For ease of exposition the term nucleotide or ribonucleotide is sometimes used herein in reference to one or more monomeric subunits of an RNA agent. It will be understood herein that the usage of the term "ribonucleotide" or "nucleotide", herein can, in the case of a modified RNA or nucleotide surrogate, also refer to a modified nucleotide, or surrogate replacement moiety at one or more positions.) Thus, the iRNA agent is or includes a region which is at least partially, and in some embodiments fully, complementary to the target RNA. It is not necessary that there be perfect complementarity between the iRNA agent and the target, but the correspondence must be sufficient to enable the iRNA agent, or a cleavage product thereof, to direct sequence specific silencing, e.g., by RNAi cleavage of the target RNA, e.g., mRNA.

Complementarity, or degree of homology with the target strand, is most critical in the antisense strand. While perfect complementarity, particularly in the antisense strand, is often desired some embodiments can include, particularly in the antisense strand, one or more but preferably 6, 5, 4, 3, 2, or fewer mismatches (with respect to the target RNA). The mismatches, particularly in the antisense strand, are most tolerated in the terminal regions and if present are preferably in a terminal region or regions, e.g., within 6, 5, 4, or 3 nucleotides of the 5' and/or 3' terminus. The sense strand need only be sufficiently complementary with the antisense strand to maintain the over all double strand character of the molecule.

As discussed elsewhere herein, an iRNA agent will often be modified or include nucleoside surrogates in addition to the RRMS. Single stranded regions of an iRNA agent will often be modified or include nucleoside surrogates, e.g., the unpaired region or regions of a hairpin structure, e.g., a region which links two complementary regions, can have modifications or nucleoside surrogates. Modification to stabilize one or more 3'- or 5'- terminus of an iRNA agent, e.g., against exonucleases, or to favor the antisense sRNA agent to enter into RISC are also favored. Modifications can include C3 (or C6, C7, C12) amino linkers, thiol linkers, carboxyl linkers, non-nucleotidic spacers (C3, C6, C9, C12, abasic, triethylene glycol, hexaethylene glycol), special biotin or fluorescein reagents that come as phosphoramidites and that have another DMT-protected hydroxyl group, allowing multiple couplings during RNA synthesis.

iRNA agents include: molecules that are long enough to trigger the interferon response (which can be cleaved by Dicer (Bernstein et al. 2001. Nature, 409:363-366) and enter a RISC(RNAi-induced silencing complex)); and, molecules which are sufficiently short that they do not trigger the interferon response (which molecules can also be cleaved by Dicer and/or enter a RISC), e.g., molecules which are of a size which allows entry into a RISC, e.g., molecules which resemble Dicer-cleavage products. Molecules that are short enough that they do not trigger an interferon response are termed sRNA agents or shorter iRNA agents herein. "sRNA agent or shorter iRNA agent" as used herein, refers to an iRNA agent, e.g., a double stranded RNA agent or single strand agent, that is sufficiently short that it does not induce a deleterious interferon response in a human cell, e.g., it has a duplexed region of less than 60 but preferably less than 50, 40, or 30 nucleotide pairs. The sRNA agent, or a cleavage product thereof, can down regulate a target gene, e.g., by inducing RNAi with respect to a target RNA, preferably an endogenous or pathogen target RNA.

Each strand of an sRNA agent can be equal to or less than 30, 25, 24, 23, 22, 21, or 20 nucleotides in length. The strand is preferably at least 19 nucleotides in length. For example, each strand can be between 21 and 25 nucleotides in length. Preferred sRNA agents have a duplex region of 17, 18, 19, 29, 21, 22, 23, 24, or 25 nucleotide pairs, and one or more overhangs, preferably one or two 3' overhangs, of 2-3 nucleotides.

In addition to homology to target RNA and the ability to down regulate a target gene, an iRNA agent will preferably have one or more of the following properties:

(1) it will be of the Formula 1, 2, 3, or 4 set out in the RNA Agent section below;

(2) if single stranded it will have a 5' modification which includes one or more phosphate groups or one or more analogs of a phosphate group;

(3) it will, despite modifications, even to a very large number, or all of the nucleosides, have an antisense strand that can present bases (or modified bases) in the proper three dimensional framework so as to be able to form correct base pairing and form a duplex structure with a homologous target RNA which is sufficient to allow down regulation of the target, e.g., by cleavage of the target RNA;

(4) it will, despite modifications, even to a very large number, or all of the nucleosides, still have "RNA-like" properties, i.e., it will possess the overall structural, chemical and physical properties of an RNA molecule, even though not exclusively, or even partly, of ribonucleotide-based content. For example, an iRNA agent can contain, e.g., a sense and/or an antisense strand in which all of the nucleotide sugars contain e.g., 2' fluoro in place of 2' hydroxyl. This deoxyribonucleotide-containing agent can still be expected to exhibit RNA-like properties. While not wishing to be bound by theory, the electronegative fluorine prefers an axial orientation when attached to the C2' position of ribose. This spatial preference of fluorine can, in turn, force the sugars to adopt a $C_{3'}$-endo pucker. This is the same puckering mode as observed in RNA molecules and gives rise to the RNA-characteristic A-family-type helix. Further, since fluorine is a good hydrogen bond acceptor, it can participate in the same hydrogen bonding interactions with water molecules that are known to stabilize RNA structures. (Generally, it is preferred that a modified moiety at the 2' sugar position will be able to enter into H-bonding which is more characteristic of the OH moiety of a ribonucleotide than the H moiety of a deoxyribonucleotide. A preferred iRNA agent will: exhibit a $C_{3'}$-endo pucker in all, or at least 50, 75, 80, 85, 90, or 95% of its sugars; exhibit a $C_{3'}$-endo pucker in a sufficient amount of its sugars that it can give rise to a the RNA-characteristic A-family-type helix; will have no more than 20, 10, 5, 4, 3, 2, or 1 sugar which is not a $C_{3'}$-endo pucker structure. These limitations are particularly preferably in the antisense strand;

(5) regardless of the nature of the modification, and even though the RNA agent can contain deoxynucleotides or modified deoxynucleotides, particularly in overhang or other single strand regions, it is preferred that DNA molecules, or any molecule in which more than 50, 60, or 70% of the nucleotides in the molecule, or more than 50, 60, or 70% of the nucleotides in a duplexed region are deoxyribonucleotides, or modified deoxyribonucleotides which are deoxy at the 2' position, are excluded from the definition of RNA agent.

A "single strand iRNA agent" as used herein, is an iRNA agent which is made up of a single molecule. It may include a duplexed region, formed by intra-strand pairing, e.g., it may be, or include, a hairpin or pan-handle structure. Single strand iRNA agents are preferably antisense with regard to the target molecule. In preferred embodiments single strand iRNA agents are 5' phosphorylated or include a phosphoryl analog at the 5' prime terminus. 5'-phosphate modifications include those which are compatible with RISC mediated gene silencing. Suitable modifications include: 5'-monophosphate ((HO)2(O)P—O-5'); 5'-diphosphate ((HO)2(O)P—O—P(HO)(O)—O-5'); 5'-triphosphate ((HO)2(O)P—O—(HO)(O)P—O—P(HO)(O)—O-5); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)2(S)P—O-5'); 5'-monodithiophosphate (phosphorodithioate; (HO)(HS)(S)P—O-5'), 5'-phosphorothiolate ((HO)2(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)2(O)P—NH-5', (HO)(NH2)(O)P—O-5'), 5'-alkylphosphonates (R=alkyl=methyl, ethyl, isopropyl, propyl, etc., e.g. RP(OH)(O)—O-5'-, (OH)2(O)P-5'-CH2-), 5'-alkyletherphosphonates (R=alkylether=methoxymethyl (MeOCH2-), ethoxymethyl, etc., e.g. RP(OH)(O)—O-5'-). (These modifications can also be used with the antisense strand of a double stranded iRNA.)

A single strand iRNA agent should be sufficiently long that it can enter the RISC and participate in RISC mediated cleavage of a target mRNA. A single strand iRNA agent is at least 14, and more preferably at least 15, 20, 25, 29, 35, 40, or 50 nucleotides in length. It is preferably less than 200, 100, or 60 nucleotides in length.

Hairpin iRNA agents will have a duplex region equal to or at least 17, 18, 19, 29, 21, 22, 23, 24, or 25 nucleotide pairs. The duplex region will preferably be equal to or less than 200, 100, or 50, in length. Preferred ranges for the duplex region are 15-30, 17 to 23, 19 to 23, and 19 to 21 nucleotides pairs in length. The hairpin will preferably have a single strand overhang or terminal unpaired region, preferably the 3', and preferably of the antisense side of the hairpin. Preferred overhangs are 2-3 nucleotides in length.

A "double stranded (ds) iRNA agent" as used herein, is an iRNA agent which includes more than one, and preferably two, strands in which interchain hybridization can form a region of duplex structure.

The antisense strand of a double stranded iRNA agent should be equal to or at least, 14, 15, 16 17, 18, 19, 25, 29, 40, or 60 nucleotides in length. It should be equal to or less than 200, 100, or 50, nucleotides in length. Preferred ranges are 17 to 25, 19 to 23, and 19 to 21 nucleotides in length.

The sense strand of a double stranded iRNA agent should be equal to or at least 14, 15, 16 17, 18, 19, 25, 29, 40, or 60 nucleotides in length. It should be equal to or less than 200, 100, or 50, nucleotides in length. Preferred ranges are 17 to 25, 19 to 23, and 19 to 21 nucleotides in length.

The double strand portion of a double stranded iRNA agent should be equal to or at least, 14, 15, 16 17, 18, 19, 20, 21, 22, 23, 24, 25, 29, 40, or 60 nucleotide pairs in length. It should be equal to or less than 200, 100, or 50, nucleotides pairs in length. Preferred ranges are 15-30, 17 to 23, 19 to 23, and 19 to 21 nucleotides pairs in length.

In many embodiments, the ds iRNA agent is sufficiently large that it can be cleaved by an endogenous molecule, e.g., by Dicer, to produce smaller ds iRNA agents, e.g., sRNAs agents It may be desirable to modify one or both of the antisense and sense strands of a double strand iRNA agent. In some cases they will have the same modification or the same class of modification but in other cases the sense and antisense strand will have different modifications, e.g., in some cases it is desirable to modify only the sense strand. It may be desirable to modify only the sense strand, e.g., to inactivate it, e.g., the sense strand can be modified in order to inactivate the sense strand and prevent formation of an active sRNA/protein or RISC. This can be accomplished by a modification which prevents 5'-phosphorylation of the sense strand, e.g., by modification with a 5'-O-methyl ribonucleotide (see Nykänen et al., (2001) ATP requirements and small interfering RNA structure in the RNA interference pathway. Cell 107, 309-321.) Other modifications which prevent phosphorylation can also be used, e.g., simply substituting the 5'-OH by H rather than O-Me. Alternatively, a large bulky group may be added to the 5'-phosphate turning it into a phosphodiester linkage, though this may be less desirable as phosphodiesterases can cleave such a linkage and release a functional sRNA 5'-end. Antisense strand modifications include 5' phosphorylation as well as any of the other 5' modifications discussed herein, particularly the 5' modifications discussed above in the section on single stranded iRNA molecules.

It is preferred that the sense and antisense strands be chosen such that the ds iRNA agent includes a single strand or unpaired region at one or both ends of the molecule. Thus, a ds iRNA agent contains sense and antisense strands, preferable paired to contain an overhang, e.g., one or two 5' or 3' overhangs but preferably a 3' overhang of 2-3 nucleotides. Most embodiments will have a 3' overhang. Preferred sRNA agents will have single-stranded overhangs, preferably 3' overhangs, of 1 or preferably 2 or 3 nucleotides in length at each end. The overhangs can be the result of one strand being longer than the other, or the result of two strands of the same length being staggered. 5' ends are preferably phosphorylated.

Preferred lengths for the duplexed region is between 15 and 30, most preferably 18, 19, 20, 21, 22, and 23 nucleotides in length, e.g., in the sRNA agent range discussed above. sRNA agents can resemble in length and structure the natural Dicer processed products from long dsRNAs. Embodiments in which the two strands of the sRNA agent are linked, e.g., covalently linked are also included. Hairpin, or other single strand structures which provide the required double stranded region, and preferably a 3' overhang are also within the invention.

The isolated iRNA agents described herein, including ds iRNA agents and sRNA agents can mediate silencing of a target RNA, e.g., mRNA, e.g., a transcript of a gene that encodes a protein. For convenience, such mRNA is also referred to herein as mRNA to be silenced. Such a gene is also referred to as a target gene. In general, the RNA to be silenced is an endogenous gene or a pathogen gene. In addition, RNAs other than mRNA, e.g., tRNAs, and viral RNAs, can also be targeted.

As used herein, the phrase "mediates RNAi" refers to the ability to silence, in a sequence specific manner, a target RNA. While not wishing to be bound by theory, it is believed that silencing uses the RNAi machinery or process and a guide RNA, e.g., an sRNA agent of 21 to 23 nucleotides.

As used herein, "specifically hybridizable" and "complementary" are terms which are used to indicate a sufficient degree of complementarity such that stable and specific binding occurs between a compound of the invention and a target RNA molecule. Specific binding requires a sufficient degree of complementarity to avoid non-specific binding of the oligomeric compound to non-target sequences under conditions in which specific binding is desired, i.e., under physiological conditions in the case of in vivo assays or therapeutic treatment, or in the case of in vitro assays, under conditions in which the assays are performed. The non-target sequences typically differ by at least 5 nucleotides.

In one embodiment, an iRNA agent is "sufficiently complementary" to a target RNA, e.g., a target mRNA, such that the iRNA agent silences production of protein encoded by the target mRNA. In another embodiment, the iRNA agent is "exactly complementary" (excluding the RRMS containing subunit(s)) to a target RNA, e.g., the target RNA and the iRNA agent anneal, preferably to form a hybrid made exclusively of Watson-Crick basepairs in the region of exact complementarity. A "sufficiently complementary" target RNA can include an internal region (e.g., of at least 10 nucleotides) that is exactly complementary to a target RNA. Moreover, in some embodiments, the iRNA agent specifically discriminates a single-nucleotide difference. In this case, the iRNA agent only mediates RNAi if exact complementary is found in the region (e.g., within 7 nucleotides of) the single-nucleotide difference.

As used herein, the term "oligonucleotide" refers to a nucleic acid molecule (RNA or DNA) preferably of length less than 100, 200, 300, or 400 nucleotides.

RNA agents discussed herein include otherwise unmodified RNA as well as RNA which have been modified, e.g., to improve efficacy, and polymers of nucleoside surrogates. Unmodified RNA refers to a molecule in which the components of the nucleic acid, namely sugars, bases, and phosphate moieties, are the same or essentially the same as that which occur in nature, preferably as occur naturally in the human body. The art has referred to rare or unusual, but naturally occurring, RNAs as modified RNAs, see, e.g., Limbach et al., (1994) Summary: the modified nucleosides of RNA, Nucleic Acids Res. 22: 2183-2196. Such rare or unusual RNAs, often termed modified RNAs (apparently because the are typically the result of a post transcriptionally modification) are within the term unmodified RNA, as used herein. Modified RNA as used herein refers to a molecule in which one or more of the components of the nucleic acid, namely sugars, bases, and phosphate moieties, are different from that which occur in nature, preferably different from that which occurs in the human body. While they are referred to as modified "RNAs," they will of course, because of the modification, include molecules which are not RNAs. Nucleoside surrogates are molecules in which the ribophosphate backbone is replaced with a non-ribophosphate construct that allows the bases to the presented in the correct spatial relationship such that hybridization is substantially similar to what is seen with a ribophosphate backbone, e.g., non-charged mimics of the ribophosphate backbone. Examples of all of the above are discussed herein.

Much of the discussion below refers to single strand molecules. In many embodiments of the invention a double stranded iRNA agent, e.g., a partially double stranded iRNA agent, is required or preferred. Thus, it is understood that that double stranded structures (e.g. where two separate molecules are contacted to form the double stranded region or where the double stranded region is formed by intramolecular pairing (e.g., a hairpin structure)) made of the single stranded structures described below are within the invention. Preferred lengths are described elsewhere herein.

As nucleic acids are polymers of subunits or monomers, many of the modifications described below occur at a position which is repeated within a nucleic acid, e.g., a modification of a base, or a phosphate moiety, or the a non-linking O of a phosphate moiety. In some cases the modification will occur at all of the subject positions in the nucleic acid but in many, and infact in most cases it will not. By way of example, a modification may only occur at a 3' or 5' terminal position, may only occur in a terminal regions, e.g. at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking O position may only occur at one or both termini, may only occur in a terminal regions, e.g., at a position on a terminal nucleotide or in the last 2, 3, 4, 5, or 10 nucleotides of a strand, or may occur in double strand and single strand regions, particularly at termini. The 5' end or ends can be phosphorylated.

In some embodiments it is particularly preferred, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang will be modified, e.g., with a modification described herein. Modifications can include, e.g., the use of modifications at the 2' OH group of the ribose sugar, e.g., the use of deoxyribonucleotides, e.g., deoxythymidine, instead of ribonucleotides, and modifications in the phosphate group, e.g., phosphothioate modifications. Overhangs need not be homologous with the target sequence.

Modifications and nucleotide surrogates are discussed below.

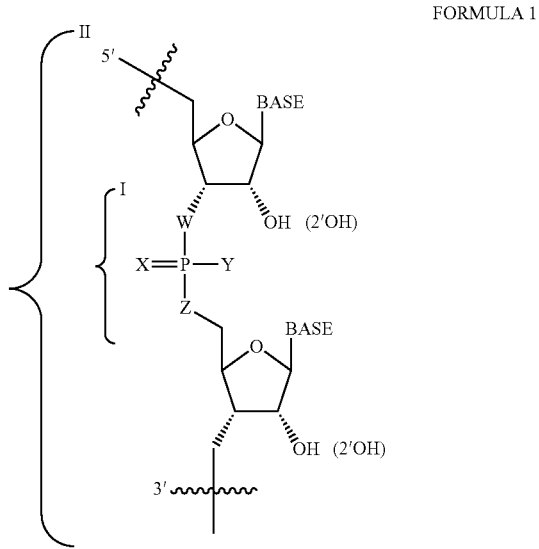

FORMULA 1

The scaffold presented above in Formula 1 represents a portion of a ribonucleic acid. The basic components are the ribose sugar, the base, the terminal phosphates, and phosphate internucleotide linkers. Where the bases are naturally occurring bases, e.g., adenine, uracil, guanine or cytosine, the sugars are the unmodified 2' hydroxyl ribose sugar (as depicted) and W, X, Y, and Z are all O, Formula 1 represents a naturally occurring unmodified oligoribonucleotide.

Unmodified oligoribonucleotides may be less than optimal in some applications, e.g., unmodified oligoribonucleotides can be prone to degradation by e.g., cellular nucleases. Nucleases can hydrolyze nucleic acid phosphodiester bonds. However, chemical modifications to one or more of the above RNA components can confer improved properties, and, e.g., can render oligoribonucleotides more stable to nucleases. Unmodified oligoribonucleotides may also be less than optimal in terms of offering tethering points for attaching ligands or other moieties to an iRNA agent.

Modified nucleic acids and nucleotide surrogates can include one or more of:

(i) alteration, e.g., replacement, of one or both of the non-linking (X and Y) phosphate oxygens and/or of one or more of the linking (W and Z) phosphate oxygens (When the phosphate is in the terminal position, one of the positions W or Z will not link the phosphate to an additional element in a naturally occurring ribonucleic acid. However, for simplicity of terminology, except where otherwise noted, the W position at the 5' end of a nucleic acid and the terminal Z position at the 3' end of a nucleic acid, are within the term "linking phosphate oxygens" as used herein.);

(ii) alteration, e.g., replacement, of a constituent of the ribose sugar, e.g., of the 2' hydroxyl on the ribose sugar, or wholesale replacement of the ribose sugar with a structure other than ribose, e.g., as described herein;

(iii) wholesale replacement of the phosphate moiety (bracket I) with "dephospho" linkers;

(iv) modification or replacement of a naturally occurring base;

(v) replacement or modification of the ribose-phosphate backbone (bracket II);

(vi) modification of the 3' end or 5' end of the RNA, e.g., removal, modification or replacement of a terminal phosphate group or conjugation of a moiety, e.g. a fluorescently labeled moiety, to either the 3' or 5' end of RNA.

The terms replacement, modification, alteration, and the like, as used in this context, do not imply any process limitation, e.g., modification does not mean that one must start with a reference or naturally occurring ribonucleic acid and modify it to produce a modified ribonucleic acid bur rather modified simply indicates a difference from a naturally occurring molecule.

It is understood that the actual electronic structure of some chemical entities cannot be adequately represented by only one canonical form (i.e. Lewis structure). While not wishing to be bound by theory, the actual structure can instead be some hybrid or weighted average of two or more canonical forms, known collectively as resonance forms or structures. Resonance structures are not discrete chemical entities and exist only on paper. They differ from one another only in the placement or "localization" of the bonding and nonbonding electrons for a particular chemical entity. It can be possible for one resonance structure to contribute to a greater extent to the hybrid than the others. Thus, the written and graphical descriptions of the embodiments of the present invention are made in terms of what the art recognizes as the predominant resonance form for a particular species. For example, any phosphoroamidate (replacement of a nonlinking oxygen with nitrogen) would be represented by X=O and Y=N in the above figure.

Specific modifications are discussed in more detail below.

The Phosphate Group

The phosphate group is a negatively charged species. The charge is distributed equally over the two non-linking oxygen atoms (i.e., X and Y in Formula 1 above). However, the phosphate group can be modified by replacing one of the oxygens with a different substituent. One result of this modification to RNA phosphate backbones can be increased resistance of the oligoribonucleotide to nucleolytic breakdown. Thus while not wishing to be bound by theory, it can be desirable in some embodiments to introduce alterations which result in either an uncharged linker or a charged linker with unsymmetrical charge distribution.

Examples of modified phosphate groups include phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. Unlike the situation where only one of X or Y is altered, the phosphorus center in the phosphorodithioates is achiral which precludes the formation of oligoribonucleotides diastereomers. Diastereomer formation can result in a preparation in which the individual diastereomers exhibit varying resistance to nucleases. Further, the hybridization affinity of RNA containing chiral phosphate groups can be lower relative to the corresponding unmodified RNA species. Thus, while not wishing to be bound by theory, modifications to both X and Y which eliminate the chiral center, e.g. phosphorodithioate formation, may be desirable in that they cannot produce diastereomer mixtures. Thus, X can be any one of S, Se, B, C, H, N, or OR (R is alkyl or aryl). Thus Y can be any one of S, Se, B, C, H, N, or OR (R is alkyl or aryl). Replacement of X and/or Y with sulfur is preferred.

The phosphate linker can also be modified by replacement of a linking oxygen (i.e., W or Z in Formula 1) with nitrogen (bridged phosphoroamidates), sulfur (bridged phosphorothioates) and carbon (bridged methylenephosphonates). The replacement can occur at a terminal oxygen (position W (3') or position Z (5'). Replacement of W with carbon or Z with nitrogen is preferred.

Candidate agents can be evaluated for suitability as described below.

The Sugar Group

A modified RNA can include modification of all or some of the sugar groups of the ribonucleic acid. E.g., the 2' hydroxyl group (OH) can be modified or replaced with a number of different "oxy" or "deoxy" substituents. While not being bound by theory, enhanced stability is expected since the hydroxyl can no longer be deprotonated to form a 2' alkoxide ion. The 2' alkoxide can catalyze degradation by intramolecular nucleophilic attack on the linker phosphorus atom. Again, while not wishing to be bound by theory, it can be desirable to some embodiments to introduce alterations in which alkoxide formation at the 2' position is not possible.

Examples of "oxy"-2' hydroxyl group modifications include alkoxy or aryloxy (OR, e.g., R=H, alkyl, cycloalkyl, aryl, aralkyl, heteroaryl or sugar); polyethyleneglycols (PEG), $O(CH_2CH_2O)_nCH_2CH_2OR$; "locked" nucleic acids (LNA) in which the 2' hydroxyl is connected, e.g., by a methylene bridge, to the 4' carbon of the same ribose sugar; O-AMINE (AMINE=$NH_2$; alkylamino, dialkylamino, heterocyclyl, arylamino, diaryl amino, heteroaryl amino, or diheteroaryl amino, ethylene diamine, polyamino) and aminoalkoxy, $O(CH_2)_n$AMINE, (e.g., AMINE=$NH_2$; alkylamino, dialkylamino, heterocyclyl, arylamino, diaryl amino, heteroaryl amino, or diheteroaryl amino, ethylene diamine, polyamino). It is noteworthy that oligonucleotides containing only the methoxyethyl group (MOE), ($OCH_2CH_2OCH_3$, a PEG derivative), exhibit nuclease stabilities comparable to those modified with the robust phosphorothioate modification.

"Deoxy" modifications include hydrogen (i.e. deoxyribose sugars, which are of particular relevance to the overhang portions of partially ds RNA); halo (e.g., fluoro); amino (e.g. $NH_2$; alkylamino, dialkylamino, heterocyclyl, arylamino, diaryl amino, heteroaryl amino, diheteroaryl amino, or amino acid); $NH(CH_2CH_2NH)_nCH_2CH_2$-AMINE (AMINE=$NH_2$; alkylamino, dialkylamino, heterocyclyl, arylamino, diaryl amino, heteroaryl amino, or diheteroaryl amino), —NHC(O)R (R=alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino functionality. Preferred substitutents are 2'-methoxyethyl, 2'-OCH3, 2'-O-allyl, 2'-C-allyl, and 2'-fluoro.

The sugar group can also contain one or more carbons that possess the opposite stereochemical configuration than that of the corresponding carbon in ribose. Thus, a modified RNA can include nucleotides containing e.g., arabinose, as the sugar.

Modified RNA's can also include "abasic" sugars, which lack a nucleobase at C-1'. These abasic sugars can also be further contain modifications at one or more of the constituent sugar atoms.

To maximize nuclease resistance, the 2' modifications can be used in combination with one or more phosphate linker modifications (e.g., phosphorothioate). The so-called "chimeric" oligonucleotides are those that contain two or more different modifications.

The modification can also entail the wholesale replacement of a ribose structure with another entity at one or more sites in the iRNA agent. These modifications are described in section entitled Ribose Replacements for RRMSs.

Candidate modifications can be evaluated as described below.

Replacement of the Phosphate Group

The phosphate group can be replaced by non-phosphorus containing connectors (cf. Bracket I in Formula 1 above). While not wishing to be bound by theory, it is believed that since the charged phosphodiester group is the reaction center in nucleolytic degradation, its replacement with neutral structural mimics should impart enhanced nuclease stability. Again, while not wishing to be bound by theory, it can be desirable, in some embodiment, to introduce alterations in which the charged phosphate group is replaced by a neutral moiety.

Examples of moieties which can replace the phosphate group include siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino. Preferred replacements include the methylenecarbonylamino and methylenemethylimino groups.

Candidate modifications can be evaluated as described below.

Replacement of Ribophosphate Backbone

Oligonucleotide-mimicking scaffolds can also be constructed wherein the phosphate linker and ribose sugar are replaced by nuclease resistant nucleoside or nucleotide surrogates (see Bracket II of Formula 1 above). While not wishing to be bound by theory, it is believed that the absence of a repetitively charged backbone diminishes binding to proteins that recognize polyanions (e.g. nucleases). Again, while not wishing to be bound by theory, it can be desirable in some embodiment, to introduce alterations in which the bases are tethered by a neutral surrogate backbone.

Examples include the mophilino, cyclobutyl, pyrrolidine and peptide nucleic acid (PNA) nucleoside surrogates. A preferred surrogate is a PNA surrogate.

Candidate modifications can be evaluated as described below.

Terminal Modifications

The 3' and 5' ends of an oligonucleotide can be modified. Such modifications can be at the 3' end, 5' end or both ends of the molecule. They can include modification or replacement of an entire terminal phosphate or of one or more of the atoms of the phosphate group. E.g., the 3' and 5' ends of an oligonucleotide can be conjugated to other functional molecular entities such as labeling moieties, e.g., fluorophores (e.g., pyrene, TAMRA, fluorescein, Cy3 or Cy5 dyes) or protecting groups (based e.g., on sulfur, silicon, boron or ester). The functional molecular entities can be attached to the sugar through a phosphate group and/or a spacer. The terminal atom of the spacer can connect to or replace the linking atom of the phosphate group or the C-3' or C-5' 0, N, S or C group of the sugar. Alternatively, the spacer can connect to or replace the terminal atom of a nucleotide surrogate (e.g., PNAs). These spacers or linkers can include e.g., —$(CH_2)_n$—, —$(CH_2)_n$N—, —$(CH_2)_nO$—, —$(CH_2)_nS$—, $O(CH_2CH_2O)_nCH_2CH_2OH$ (e.g., n=3 or 6), abasic sugars, amide, carboxy, amine, oxyamine, oxyimine, thioether, disulfide, thiourea, sulfonamide, or morpholino, or biotin and fluorescein reagents. When a spacer/phosphate-functional molecular entity-spacer/phosphate array is interposed between two strands of iRNA agents, this array can substitute for a hairpin RNA loop in a hairpin-type RNA agent. The 3' end can be an —OH group. While not wishing to be bound by theory, it is believed that conjugation of certain moieties can improve transport, hybridization, and specificity properties. Again, while not wishing to be bound by theory, it may be desirable to introduce terminal alterations that improve nuclease resistance. Other examples of terminal modifications include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic carriers (e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles).

Terminal modifications can be added for a number of reasons, including as discussed elsewhere herein to modulate activity or to modulate resistance to degradation. Terminal modifications useful for modulating activity include modification of the 5' end with phosphate or phosphate analogs. E.g., in preferred embodiments iRNA agents, especially antisense strands, are 5' phosphorylated or include a phosphoryl analog at the 5' prime terminus. 5'-phosphate modifications include those which are compatible with RISC mediated gene silencing. Suitable modifications include: 5'-monophosphate ((HO)2(O)P—O-5'); 5'-diphosphate ((HO)2(O)P—O—P (HO)(O)—O-5'); 5'-triphosphate ((HO)2(O)P—O—(HO) (O)P—O—P(HO)(O)—O-5'); 5'-guanosine cap (7-methylated or non-methylated) (7m-G-O-5'-(HO)(O)P—O—(HO) (O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)2(S)P—O-5'); 5'-monodithiophosphate (phosphorodithioate; (HO)(HS) (S)P—O-5'), 5'-phosphorothiolate ((HO)2(O)P—S-5'); any additional combination of oxygen/sulfur replaced monophosphate, diphosphate and triphosphates (e.g. 5'-alphathiotriphosphate, 5'-gamma-thiotriphosphate, etc.), 5'-phosphoramidates ((HO)2(O)P—NH-5', (HO)(NH2)(O)P—O-5), 5'-alkylphosphonates (R=alkyl=methyl, ethyl, isopropyl, propyl, etc., e.g. RP(OH)(O)—O-5'-, (OH)2(O)P-5'-CH2-), 5'-alkyletherphosphonates (R=alkylether=methoxymethyl (MeOCH2-), ethoxymethyl, etc., e.g. RP(OH)(O)—O-5'-).

Terminal modifications useful for increasing resistance to degradation include

Terminal modifications can also be useful for monitoring distribution, and in such cases the preferred groups to be added include fluorophores, e.g., fluorscein or an Alexa dye, e.g., Alexa 488. Terminal modifications can also be useful for enhancing uptake, useful modifications for this include cholesterol. Terminal modifications can also be useful for cross-linking an RNA agent to another moiety; modifications useful for this include mitomycin C.

Candidate modifications can be evaluated as described below.

The Bases

Adenine, guanine, cytosine and uracil are the most common bases found in RNA. These bases can be modified or replaced to provide RNA's having improved properties. E.g., nuclease resistant oligoribonucleotides can be prepared with these bases or with synthetic and natural nucleobases (e.g., inosine, thymine, xanthine, hypoxanthine, nubularine, isoguanisine, or tubercidine) and any one of the above modifications. Alternatively, substituted or modified analogs of any of the above bases, e.g., "unusual bases" and "universal bases," can be employed. Examples include without limitation 2-aminoadenine, 6-methyl and other alkyl derivatives of adenine and guanine, 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 5-halouracil, 5-(2-aminopropyl)uracil, 5-amino allyl uracil, 8-halo, amino, thiol, thioalkyl, hydroxyl and other 8-substituted adenines and guanines, 5-trifluoromethyl and other 5-substituted uracils and cytosines, 7-methylguanine, 5-substituted pyrimidines, 6-azapyrimidines and N-2, N-6 and O-6 substituted purines, including 2-aminopropyladenine, 5-propynyluracil and 5-propynylcytosine, dihydrouracil, 3-deaza-5-azacytosine, 2-aminopurine, 5-alkyluracil, 7-alkylguanine, 5-alkyl cytosine, 7-deazaadenine, N6, N6-dimethyladenine, 2,6-diaminopurine, 5-amino-allyl-uracil, N3-methyluracil, substituted 1,2,4-triazoles, 2-pyridinone, 5-nitroindole, 3-nitropyrrole, 5-methoxyuracil, uracil-5-oxyacetic acid, 5-methoxycarbonylmethyluracil, 5-methyl-2-thiouracil, 5-methoxycarbonylmethyl-2-thiouracil, 5-methylaminomethyl-2-thiouracil, 3-(3-amino-3carboxypropyl)uracil, 3-methylcytosine, 5-methylcytosine, N$^4$-acetyl cytosine, 2-thiocytosine, N6-methyladenine, N6-isopentyladenine, 2-methylthio-N6-isopentenyladenine, N-methylguanines, or O-alkylated bases. Further purines and pyrimidines include those disclosed in U.S. Pat. No. 3,687,808, those disclosed in the Concise Encyclopedia Of Polymer Science And Engineering, pages 858-859, Kroschwitz, J. I., ed. John Wiley & Sons, 1990, and those disclosed by Englisch et al., Angewandte Chemie, International Edition, 1991,30, 613.

Generally, base changes are less preferred for promoting stability, but they can be useful for other reasons, e.g., some, e.g., 2,6-diaminopurine and 2 amino purine, are fluorescent. Modified bases can reduce target specificity. This should be taken into consideration in the design of iRNA agents.

Candidate modifications can be evaluated as described below.

Evaluation of Candidate RNA's

One can evaluate a candidate RNA agent, e.g., a modified RNA, for a selected property by exposing the agent or modified molecule and a control molecule to the appropriate conditions and evaluating for the presence of the selected property. For example, resistance to a degradent can be evaluated as follows. A candidate modified RNA (and preferably a control molecule, usually the unmodified form) can be exposed to degradative conditions, e.g., exposed to a milieu, which includes a degradative agent, e.g., a nuclease. E.g., one can use a biological sample, e.g., one that is similar to a milieu, which might be encountered, in therapeutic use, e.g., blood or a cellular fraction, e.g., a cell-free homogenate or disrupted cells. The candidate and control could then be evaluated for resistance to degradation by any of a number of approaches. For example, the candidate and control could be labeled, preferably prior to exposure, with, e.g., a radioactive or enzymatic label, or a fluorescent label, such as Cy3 or Cy5.

Control and modified RNA's can be incubated with the degradative agent, and optionally a control, e.g., an inactivated, e.g., heat inactivated, degradative agent. A physical parameter, e.g., size, of the modified and control molecules are then determined. They can be determined by a physical method, e.g., by polyacrylamide gel electrophoresis or a sizing column, to assess whether the molecule has maintained its original length, or assessed functionally. Alternatively, Northern blot analysis can be used to assay the length of an unlabeled modified molecule.

A functional assay can also be used to evaluate the candidate agent. A functional assay can be applied initially or after an earlier non-functional assay, (e.g., assay for resistance to degradation) to determine if the modification alters the ability of the molecule to silence gene expression. For example, a cell, e.g., a mammalian cell, such as a mouse or human cell, can be co-transfected with a plasmid expressing a fluorescent protein, e.g., GFP, and a candidate RNA agent homologous to the transcript encoding the fluorescent protein (see, e.g., WO 00/44914). For example, a modified dsRNA homologous to the GFP mRNA can be assayed for the ability to inhibit GFP expression by monitoring for a decrease in cell fluorescence, as compared to a control cell, in which the transfection did not include the candidate dsRNA, e.g., controls with no agent added and/or controls with a non-modified RNA added. Efficacy of the candidate agent on gene expression can be assessed by comparing cell fluorescence in the presence of the modified and unmodified dsRNA agents.

In an alternative functional assay, a candidate dsRNA agent homologous to an endogenous mouse gene, preferably a maternally expressed gene, such as c-mos, can be injected into an immature mouse oocyte to assess the ability of the agent to inhibit gene expression in vivo (see, e.g., WO 01/36646). A phenotype of the oocyte, e.g., the ability to maintain arrest in metaphase II, can be monitored as an indicator that the agent is inhibiting expression. For example, cleavage of c-mos mRNA by a dsRNA agent would cause the oocyte to exit metaphase arrest and initiate parthenogenetic development (Colledge et al. Nature 370: 65-68, 1994; Hashimoto et al. Nature, 370:68-71, 1994). The effect of the modified agent on target RNA levels can be verified by Northern blot to assay for a decrease in the level of target mRNA, or by Western blot to assay for a decrease in the level of target protein, as compared to a negative control. Controls can include cells in which with no agent is added and/or cells in which a non-modified RNA is added.

References

General References

The oligoribonucleotides and oligoribonucleosides used in accordance with this invention may be with solid phase synthesis, see for example "Oligonucleotide synthesis, a practical approach", Ed. M. J. Gait, IRL Press, 1984; "Oligonucleotides and Analogues, A Practical Approach", Ed. F. Eckstein, IRL Press, 1991 (especially Chapter 1, Modern machine-aided methods of oligodeoxyribonucleotide synthesis, Chapter 2, Oligoribonucleotide synthesis, Chapter 3,2'-O-Methyloligoribonucleotide-s: synthesis and applications, Chapter 4, Phosphorothioate oligonucleotides, Chapter 5, Synthesis of oligonucleotide phosphorodithioates, Chapter 6, Synthesis of oligo-2'-deoxyribonucleoside methylphosphonates, and. Chapter 7, Oligodeoxynucleotides containing modified bases. Other particularly useful synthetic procedures, reagents, blocking groups and reaction conditions are described in Martin, P., *Helv. Chim. Acta*, 1995, 78, 486-504; Beaucage, S. L. and Iyer, R. P., *Tetrahedron*, 1992, 48, 2223-2311 and Beaucage, S. L. and Iyer, R. P., *Tetrahedron*, 1993, 49, 6123-6194, or references referred to therein.

Modification described in WO 00/44895, WO01/75164, or WO02/44321 can be used herein.

The disclosure of all publications, patents, and published patent applications listed herein are hereby incorporated by reference.

Phosphate Group References

The preparation of phosphinate oligoribonucleotides is described in U.S. Pat. No. 5,508,270. The preparation of alkyl phosphonate oligoribonucleotides is described in U.S. Pat. No. 4,469,863. The preparation of phosphoramidite oligoribonucleotides is described in U.S. Pat. Nos. 5,256,775 or 5,366,878. The preparation of phosphotriester oligoribonucleotides is described in U.S. Pat. No. 5,023,243. The preparation of borano phosphate oligoribonucleotide is described in U.S. Pat. Nos. 5,130,302 and 5,177,198. The preparation of 3'-Deoxy-3'-amino phosphoramidate oligoribonucleotides is described in U.S. Pat. No. 5,476,925. 3'-Deoxy-3'-methylenephosphonate oligoribonucleotides is described in An, H, et al. *J. Org. Chem.* 2001, 66, 2789-2801. Preparation of sulfur bridged nucleotides is described in Sproat et al. *Nucleosides Nucleotides* 1988, 7,651 and Crosstick et al. *Tetrahedron Lett.* 1989, 30, 4693.

Sugar Group References

Modifications to the 2' modifications can be found in Verma, S. et al. *Annu. Rev. Biochem.* 1998, 67, 99-134 and all references therein. Specific modifications to the ribose can be found in the following references: 2'-fluoro (Kawasaki et. al., *J. Med. Chem.*, 1993, 36, 831-841), 2'-MOE (Martin, P. *Helv. Chim. Acta* 1996, 79, 1930-1938), "LNA" (Wengel, J. *Acc. Chem. Res.* 1999, 32, 301-310).

Replacement of the Phosphate Group References

Methylenemethylimino linked oligoribonucleosides, also identified herein as MMI linked oligoribonucleosides, methylenedimethylhydrazo linked oligoribonucleosides, also identified herein as MDH linked oligoribonucleosides, and methylenecarbonylamino linked oligonucleosides, also identified herein as amide-3 linked oligoribonucleosides, and methyleneaminocarbonyl linked oligonucleosides, also identified herein as amide-4 linked oligoribonucleosides as well as mixed backbone compounds having, as for instance, alternating MMI and PO or PS linkages can be prepared as is described in U.S. Pat. Nos. 5,378,825, 5,386,023, 5,489,677 and in published PCT applications PCT/US92/04294 and PCT/US92/04305 (published as WO 92/20822 WO and 92/20823, respectively). Formacetal and thioformacetal linked oligoribonucleosides can be prepared as is described in U.S. Pat. Nos. 5,264,562 and 5,264,564. Ethylene oxide linked oligoribonucleosides can be prepared as is described in U.S. Pat. No. 5,223,618. Siloxane replacements are described in Cormier, J. F. et al. *Nucleic Acids Res.* 1988, 16, 4583. Carbonate replacements are described in Tittensor, J. R. *J. Chem. Soc. C* 1971, 1933. Carboxymethyl replacements are described in Edge, M. D. et al. *J. Chem. Soc. Perkin Trans.* 1 1972, 1991. Carbamate replacements are described in Stirchak, E. P. Nucleic Acids Res. 1989, 17, 6129.

Replacement of the Phosphate-Ribose Backbone References

Cyclobutyl sugar surrogate compounds can be prepared as is described in U.S. Pat. No. 5,359,044. Pyrrolidine sugar surrogate can be prepared as is described in U.S. Pat. No. 5,519,134. Morpholino sugar surrogates can be prepared as is described in U.S. Pat. Nos. 5,142,047 and 5,235,033, and other related patent disclosures. Peptide Nucleic Acids (PNAS) are known per se and can be prepared in accordance with any of the various procedures referred to in Peptide Nucleic Acids (PNA): Synthesis, Properties and Potential Applications, Bioorganic & Medicinal Chemistry, 1996, 4, 5-23. They may also be prepared in accordance with U.S. Pat. No. 5,539,083.

Terminal Modification References

Terminal modifications are described in Manoharan, M. et al. *Antisense and Nucleic Acid Drug Development* 12, 103-128 (2002) and references therein.

Bases References

N-2 substitued purine nucleoside amidites can be prepared as is described in U.S. Pat. No. 5,459,255. 3-Deaza purine nucleoside amidites can be prepared as is described in U.S. Pat. No. 5,457,191. 5,6-Substituted pyrimidine nucleoside amidites can be prepared as is described in U.S. Pat. No. 5,614,617. 5-Propynyl pyrimidine nucleoside amidites can be prepared as is described in U.S. Pat. No. 5,484,908. Additional references can be disclosed in the above section on base modifications.

Preferred iRNA Agents

Preferred RNA agents have the following structure (see Formula 2 below):

FORMULA 2

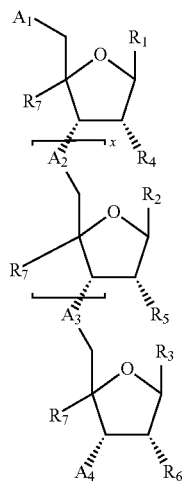

Referring to Formula 2 above, $R^1$, $R^2$, and $R^3$ are each, independently, H, (i.e. abasic nucleotides), adenine, guanine, cytosine and uracil, inosine, thymine, xanthine, hypoxanthine, nubularine, tubercidine, isoguanisine, 2-aminoadenine, 6-methyl and other alkyl derivatives of adenine and guanine, 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 5-halouracil, 5-(2-aminopropyl) uracil, 5-amino allyl uracil, 8-halo, amino, thiol, thioalkyl, hydroxyl and other 8-substituted adenines and guanines, 5-trifluoromethyl and other 5-substituted uracils and cytosines, 7-methylguanine, 5-substituted pyrimidines, 6-azapyrimidines and N-2, N-6 and O-6 substituted purines, including 2-aminopropyladenine, 5-propynyluracil and 5-propynylcytosine, dihydrouracil, 3-deaza-5-azacytosine, 2-aminopurine, 5-alkyluracil, 7-alkylguanine, 5-alkyl cytosine, 7-deazaadenine, 7-deazaguanine, N6, N6-dimethyladenine, 2,6-diaminopurine, 5-amino-allyl-uracil, N3-methyluracil, substituted 1,2,4-triazoles, 2-pyridinone, 5-nitroindole, 3-nitropyrrole, 5-methoxyuracil, uracil-5-oxyacetic acid, 5-methoxycarbonylmethyluracil, 5-methyl-2-thiouracil, 5-methoxycarbonylmethyl-2-thiouracil, 5-methylaminomethyl-2-thiouracil, 3-(3-amino-3-carboxypropyl)uracil, 3-methylcytosine, 5-methylcytosine, $N^4$-acetyl cytosine, 2-thiocytosine, N6-methyladenine, N6-isopentyladenine, 2-methylthio-N6-isopentenyladenine, N-methylguanines, or O-alkylated bases.

$R^4$, $R^5$, and $R^6$ are each, independently, $OR^8$, $O(CH_2CH_2O)_mCH_2CH_2OR^8$; $O(CH_2)_nR^9$; $O(CH_2)_nOR^9$, H; halo; $NH_2$; $NHR^8$; $N(R^8)_2$; $NH(CH_2CH_2NH)_m CH_2CH_2NHR^9$; $NHC(O)R^8$; cyano; mercapto, $SR^8$; alkylthio-alkyl; alkyl, aralkyl, cycloalkyl, aryl, heteroaryl, alkenyl, alkynyl, each of which may be optionally substituted with halo, hydroxy, oxo, nitro, haloalkyl, alkyl, alkaryl, aryl, aralkyl, alkoxy, aryloxy, amino, alkylamino, dialkylamino, heterocyclyl, arylamino, diaryl amino, heteroaryl amino, diheteroaryl amino, acylamino, alkylcarbamoyl, arylcarbamoyl, aminoalkyl, alkoxycarbonyl, carboxy, hydroxyalkyl, alkanesulfonyl, alkanesulfonamido, arenesulfonamido, aralkylsulfonamido, alkylcarbonyl, acyloxy, cyano, or ureido; or $R^4$, $R^5$, or $R^6$ together combine with $R^7$ to form an [—O—$CH_2$—] covalently bound bridge between the sugar 2' and 4' carbons.

$A^1$ is:

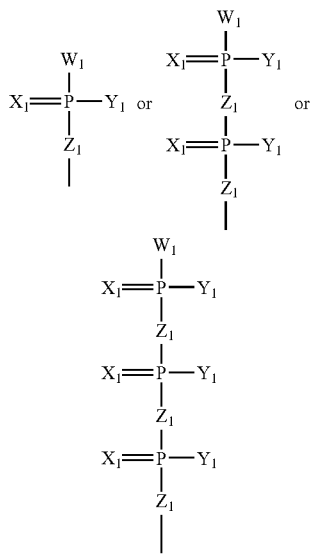

;H; OH; $OCH_3$; $W^1$; an abasic nucleotide; or absent;

(a preferred A1, especially with regard to anti-sense strands, is chosen from 5'-monophosphate ((HO)$_2$(O)P—O-5'), 5'-diphosphate ((HO)$_2$(O)P—O—P(HO)(O)—O-5'), 5'-triphosphate ((HO)$_2$(O)P—O—(HO)(O)P—O—P(HO)(O)—O-5'), 5'-guanosine cap (7-methylated or non-methylated) (7m-G-O-5'-(HO)(O)P—O—(HO)(O)P—O—P(HO)(O)—O-5'), 5'-adenosine cap (Appp), and any modified or unmodified nucleotide cap structure (N—O-5'-(HO)(O)P—O—(HO)(O)P—O—P(HO)(O)—O-5'), 5'-monothiophosphate (phosphorothioate; (HO)$_2$(S)P—O-5'), 5'-monodithiophosphate (phosphorodithioate; (HO)(HS)(S)P—O-5'), 5'-phosphorothiolate ((HO)$_2$(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)$_2$(O)P—NH-5', (HO)(NH$_2$)(O)P—O-5'), 5'-alkylphosphonates (R=alkyl=methyl, ethyl, isopropyl, propyl, etc., e.g. RP(OH)(O)—O-5'-, (OH)$_2$(O)P-5'-CH$_2$—), 5'-alkyletherphosphonates (R=alkylether=methoxymethyl (MeOCH$_2$—), ethoxymethyl, etc., e.g. RP(OH)(O)—O-5'-)).

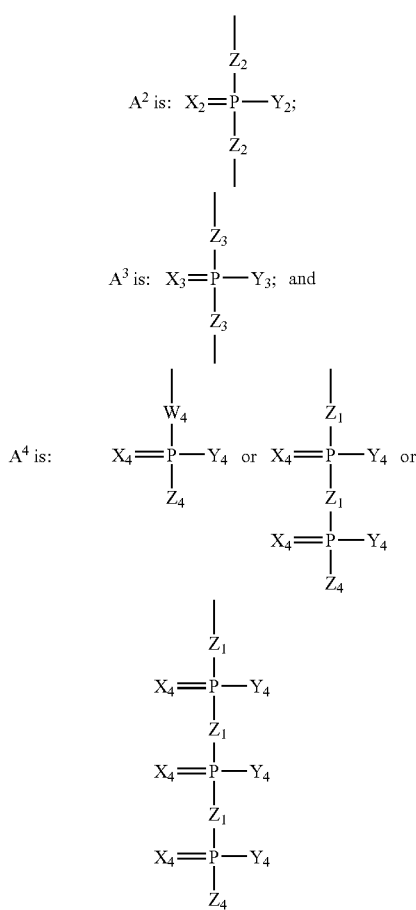

;H; $Z^4$; an inverted nucleotide; an abasic nucleotide; or absent.

$W^1$ is OH, $(CH_2)_nR^{10}$, $(CH_2)_nNHR^{10}$, $(CH_2)_nOR^{10}$, $(CH_2)_nSR^{10}$; $O(CH_2)_nR^{10}$; $O(CH_2)_nOR^{10}$, $O(CH_2)_nNR^{10}$, $O(CH_2)_nSR^{10}$; $O(CH_2)_nSS(CH_2)_nOR^{10}$, $O(CH_2)_nC(O)OR^{10}$, $NH(CH_2)_nR^{10}$; $NH(CH_2)_nNR^{10}$; $NH(CH_2)_nOR^{10}$, $NH(CH_2)_nSR^{10}$; $S(CH_2)_nR^{10}$, $S(CH_2)_nNR^{10}$, $S(CH_2)_nOR^{10}$, $S(CH_2)_nSR^{10}$ $O(CH_2CH_2O)_mCH_2CH_2OR^{10}$; $O(CH_2CH_2O)_m CH_2CH_2NHR^{10}$, $NH(CH_2CH_2NH)_m CH_2CH_2NHR^{10}$; $Q-R^{10}$, $O-Q-R^{10}$ $N-Q-R^{10}$, $S-Q-R^{10}$ or —O—. $W^4$ is O, $CH_2$, NH, or S.

$X^1$, $X^2$, $X^3$, and $X^4$ are each, independently, O or S.

$Y^1$, $Y^2$, $Y^3$, and $Y^4$ are each, independently, OH, O, $OR^8$, S, Se, $BH_3$—, H, $NHR^9$, $N(R^9)_2$ alkyl, cycloalkyl, aralkyl, aryl, or heteroaryl, each of which may be optionally substituted.

$Z^1$, $Z^2$, and $Z^3$ are each independently O, $CH_2$, NH, or S. $Z^4$ is OH, $(CH_2)R^{10}$, $(CH_2)_nNHR^{10}$, $(CH_2)_nOR^{10}$, $(CH_2)_nSR^{10}$; $O(CH_2)_nR^{10}$; $O(CH_2)_nOR^{10}$, $O(CH_2)_nNR^{10}$, $O(CH_2)_nSR^{10}$, $O(CH_2)_nSS(CH_2)_nOR^{10}$, $O(CH_2)_nC(O)OR^{10}$; $NH(CH_2)_nR^{10}$; $NH(CH_2)_nNR^{10}$; $NH(CH_2)_nOR^{10}$, $NH(CH_2)_nSR^{10}$; $S(CH_2)_nR^{10}$, $S(CH_2)_nNR^{10}$, $S(CH_2)_nOR^{10}$, $S(CH_2)_nSR^{10}$ $O(CH_2CH_2O)_mCH_2CH_2OR^{10}$, $O(CH_2CH_2O)_m CH_2CH_2NHR^{10}$, $NH(CH_2CH_2NH)_mCH_2CH_2NHR^{10}$; $Q-R^{10}$, $O-Q-R^{10}$ $N-Q-R^{10}$, $S-Q-R^{10}$.

x is 5-100, chosen to comply with a length for an RNA agent described herein.

$R^7$ is H; or is together combined with $R^4$, $R^5$, or $R^6$ to form an [—O—$CH_2$—] covalently bound bridge between the sugar 2' and 4' carbons.

$R^8$ is alkyl, cycloalkyl, aryl, aralkyl, heterocyclyl, heteroaryl, amino acid, or sugar; $R^9$ is $NH_2$, alkylamino, dialkylamino, heterocyclyl, arylamino, diaryl amino, heteroaryl amino, diheteroaryl amino, or amino acid; and $R^{10}$ is H; fluorophore (pyrene, TAMRA, fluorescein, Cy3 or Cy5 dyes); sulfur, silicon, boron or ester protecting group; intercalating agents (e.g. acridines), cross-linkers (e.g. psoralene, mitomycin C), porphyrins (TPPC4,texaphyrin, Sapphyrin), polycyclic aromatic hydrocarbons (e.g., phenazine, dihydrophenazine), artificial endonucleases (e.g. EDTA), lipohilic carriers (cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino; alkyl, cycloalkyl, aryl, aralkyl, heteroaryl; radiolabelled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles); or an RNA agent. m is 0-1,000,000, and n is 0-20. Q is a spacer selected from the group consisting of abasic sugar, amide, carboxy, oxyamine, oxyimine, thioether, disulfide, thiourea, sulfonamide, or morpholino, biotin or fluorescein reagents.

Preferred RNA agents in which the entire phosphate group has been replaced have the following structure (see Formula 3 below):

FORMULA 3

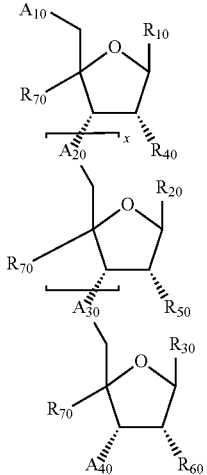

Referring to Formula 3, $A^{10}$-$A^{40}$ is L-G-L; $A^{10}$ and/or $A^{40}$ may be absent, in which L is a linker, wherein one or both L may be present or absent and is selected from the group consisting of $CH_2(CH_2)_g$; $N(CH_2)_g$; $O(CH_2)_g$; $S(CH_2)_g$. G is a functional group selected from the group consisting of siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

$R^{10}$, $R^{20}$, and $R^{30}$ are each, independently, H, (i.e. abasic nucleotides), adenine, guanine, cytosine and uracil, inosine, thymine, xanthine, hypoxanthine, nubularine, tubercidine, isoguanisine, 2-aminoadenine, 6-methyl and other alkyl derivatives of adenine and guanine, 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 5-halouracil, 5-(2-aminopropyl)uracil, 5-amino allyl uracil, 8-halo, amino, thiol, thioalkyl, hydroxyl and other 8-substituted adenines and guanines, 5-trifluoromethyl and other 5-substituted uracils and cytosines, 7-methylguanine, 5-substituted pyrimidines, 6-azapyrimidines and N-2, N-6 and O-6 substituted purines, including 2-aminopropyladenine, 5-propynyluracil and 5-propynylcytosine, dihydrouracil, 3-deaza-5-azacytosine, 2-aminopurine, 5-alkyluracil, 7-alkylguanine, 5-alkyl cytosine, 7-deazaadenine, 7-deazaguanine, N6, N6-dimethyladenine, 2,6-diaminopurine, 5-amino-allyl-uracil, N3-methyluracil substituted 1,2,4-triazoles, 2-pyridinone, 5-nitroindole, 3-nitropyrrole, 5-methoxyuracil, uracil-5-oxyacetic acid, 5-methoxycarbonylmethyluracil, 5-methyl-2-thiouracil, 5-methoxycarbonylmethyl-2-thiouracil, 5-methylaminomethyl-2-thiouracil, 3-(3-amino-3carboxypropyl)uracil, 3-methylcytosine, 5-methylcytosine, $N^4$-acetyl cytosine, 2-thiocytosine, N6-methyladenine, N6-isopentyladenine, 2-methylthio-N6-isopentenyladenine, N-methylguanines, or O-alkylated bases.

$R^{40}$, $R^{50}$, and $R^{60}$ are each, independently, $OR^8$, $O(CH_2CH_2O)_mCH_2CH_2OR^8$; $O(CH_2)_nR^9$; $O(CH_2)_nOR^9$, H; halo; $NH_2$; $NHR^8$; $N(R^8)_2$; $NH(CH_2CH_2NH)_mCH_2CH_2R^9$; $NHC(O)R^8$; cyano; mercapto, $SR^7$; alkyl-thio-alkyl; alkyl, aralkyl, cycloalkyl, aryl, heteroaryl, alkenyl, alkynyl, each of which may be optionally substituted with halo, hydroxy, oxo, nitro, haloalkyl, alkyl, alkaryl, aryl, aralkyl, alkoxy, aryloxy, amino, alkylamino, dialkylamino, heterocyclyl, arylamino, diaryl amino, heteroaryl amino, diheteroaryl amino, acylamino, alkylcarbamoyl, arylcarbamoyl, aminoalkyl, alkoxycarbonyl, carboxy, hydroxyalkyl, alkanesulfonyl, alkanesulfonamido, arenesulfonamido, aralkylsulfonamido, alkylcarbonyl, acyloxy, cyano, and ureido groups; or $R^{40}$, $R^{50}$, or $R^{60}$ together combine with $R^{70}$ to form an [—O—$CH_2$—] covalently bound bridge between the sugar 2' and 4' carbons.

x is 5-100 or chosen to comply with a length for an RNA agent described herein.

$R^{70}$ is H; or is together combined with $R^{40}$, $R^{50}$, or $R^{60}$ to form an [—O—$CH_2$—] covalently bound bridge between the sugar 2' and 4' carbons.

$R^8$ is alkyl, cycloalkyl, aryl, aralkyl, heteroaryl, heteroaryl, amino acid, or sugar; and $R^9$ is $NH_2$, alkylamino, dialkylamino, heterocyclyl, arylamino, diaryl amino, heteroaryl amino, diheteroaryl amino, or amino acid. m is 0-1,000,000, n is 0-20, and g is 0-2.

Preferred nucleoside surrogates have the following structure (see Formula 4 below):

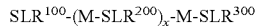

SLR$^{100}$-(M-SLR$^{200}$)$_x$-M-SLR$^{300}$  FORMULA 4

S is a nucleoside surrogate selected from the group consisting of mophilino, cyclobutyl, pyrrolidine and peptide nucleic acid. L is a linker and is selected from the group consisting of $CH_2(CH_2)_g$; $N(CH_2)_g$; $O(CH_2)_g$; $S(CH_2)_g$; —C(O)(CH$_2$)$_n$— or may be absent. M is an amide bond; sulfonamide; sulfinate; phosphate group; modified phosphate group as described herein; or may be absent.

$R^{100}$, $R^{200}$, and $R^{300}$ are each, independently, H (i.e., abasic nucleotides), adenine, guanine, cytosine and uracil, inosine, thymine, xanthine, hypoxanthine, nubularine, tubercidine, isoguanisine, 2-aminoadenine, 6-methyl and other alkyl derivatives of adenine and guanine, 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 5-halouracil, 5-(2-aminopropyl)uracil, 5-amino allyl uracil, 8-halo, amino, thiol, thioalkyl, hydroxyl and other 8-substituted adenines and guanines, 5-trifluoromethyl and other 5-substituted uracils and cytosines, 7-methylguanine, 5-substituted pyrimidines, 6-azapyrimidines and N-2, N-6 and O-6 substituted purines, including 2-aminopropyladenine, 5-propynyluracil and 5-propynylcytosine, dihydrouracil, 3-deaza-5-azacytosine, 2-aminopurine, 5-alkyluracil, 7-alkylguanine, 5-alkyl cytosine, 7-deazaadenine, 7-deazaguanine, N6, N6-dimethyladenine, 2,6-diaminopurine, 5-amino-allyl-uracil, N3-methyluracil substituted 1, 2, 4,-triazoles, 2-pyridinones, 5-nitroindole, 3-nitropyrrole, 5-methoxyuracil, uracil-5-oxyacetic acid, 5-methoxycarbonylmethyluracil, 5-methyl-2-thiouracil, 5-methoxycarbonylmethyl-2-thiouracil, 5-methylaminomethyl-2-thiouracil, 3-(3-amino-3carboxypropyl)uracil, 3-methylcytosine, 5-methylcytosine, $N^4$-acetyl cytosine, 2-thiocytosine, N6-methyladenine, N6-isopentyladenine, 2-methylthio-N6-isopentenyladenine, N-methylguanines, or O-alkylated bases.

x is 5-100, or chosen to comply with a length for an RNA agent described herein; and g is 0-2.

Nuclease Resistant Monomers

In one aspect, the invention features a nuclease resistant monomer, or a an iRNA agent which incorporates a nuclease resistant monomer (NMR), such as those described herein and those described in copending, co-owned U.S. Provisional Application Ser. No. 60/469,612, filed on May 9, 2003, which is hereby incorporated by reference.

In addition, the invention includes iRNA agents having a NMR and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA agent having an architecture or structure described herein, an iRNA associated with an amphipathic delivery agent described herein, an iRNA associated with a drug delivery module described herein, an iRNA agent administered as described herein, or an iRNA agent formulated as described herein, which also incorporates a NMR.

An iRNA agent can include monomers which have been modified so as to inhibit degradation, e.g., by nucleases, e.g., endonucleases or exonucleases, found in the body of a subject. These monomers are referred to herein as NRM's, or nuclease resistance promoting monomers or modifications. In many cases these modifications will modulate other properties of the iRNA agent as well, e.g., the ability to interact with a protein, e.g., a transport protein, e.g., serum albumin, or a member of the RISC(RNA-induced Silencing Complex), or the ability of the first and second sequences to form a duplex with one another or to form a duplex with another sequence, e.g., a target molecule.

While not wishing to be bound by theory, it is believed that modifications of the sugar, base, and/or phosphate backbone in an iRNA agent can enhance endonuclease and exonuclease resistance, and can enhance interactions with transporter proteins and one or more of the functional components of the RISC complex. Preferred modifications are those that increase exonuclease and endonuclease resistance and thus prolong the halflife of the iRNA agent prior to interaction with the RISC complex, but at the same time do not render the iRNA agent resistant to endonuclease activity in the RISC complex. Again, while not wishing to be bound by any theory, it is believed that placement of the modifications at or near the 3' and/or 5' end of antisense strands can result in iRNA agents that meet the preferred nuclease resistance criteria delineated above. Again, still while not wishing to be bound by any theory, it is believed that placement of the modifications at e.g., the middle of a sense strand can result in iRNA agents that are relatively less likely to undergo off-targeting.

Modifications described herein can be incorporated into any double-stranded RNA and RNA-like molecule described herein, e.g., an iRNA agent. An iRNA agent may include a duplex comprising a hybridized sense and antisense strand, in which the antisense strand and/or the sense strand may include one or more of the modifications described herein. The anti sense strand may include modifications at the 3' end and/or the 5' end and/or at one or more positions that occur 1-6 (e.g., 1-5, 1-4, 1-3, 1-2) nucleotides from either end of the strand. The sense strand may include modifications at the 3' end and/or the 5' end and/or at any one of the intervening positions between the two ends of the strand. The iRNA agent may also include a duplex comprising two hybridized antisense strands. The first and/or the second antisense strand may include one or more of the modifications described herein. Thus, one and/or both antisense strands may include modifications at the 3' end and/or the 5' end and/or at one or more positions that occur 1-6 (e.g., 1-5, 1-4, 1-3, 1-2) nucleotides from either end of the strand. Particular configurations are discussed below.

Modifications that can be useful for producing iRNA agents that meet the preferred nuclease resistance criteria delineated above can include one or more of the following chemical and/or stereochemical modifications of the sugar, base, and/or phosphate backbone:

(i) chiral ($S_p$) thioates. Thus, preferred NRM's include nucleotide dimers with an enriched or pure for a particular chiral form of a modified phosphate group containing a heteroatom at the nonbridging position, e.g., Sp or Rp, at the position X, where this is the position normally occupied by the oxygen. The atom at X can also be S, Se, $Nr_2$, or $Br_3$. When X is S, enriched or chirally pure Sp linkage is preferred. Enriched means at least 70, 80, 90, 95, or 99% of the preferred form. Such NRM's are discussed in more detail below;

(ii) attachment of one or more cationic groups to the sugar, base, and/or the phosphorus atom of a phosphate or modified phosphate backbone moiety. Thus, preferred NRM's include monomers at the terminal position derivitized at a cationic group. As the 5' end of an antisense sequence should have a terminal —OH or phosphate group this NRM is preferably not used at th 5' end of an anti-sense sequence. The group should be attached at a position on the base which minimizes interference with H bond formation and hybridization, e.g., away form the face which interacts with the complementary base on the other strand, e.g, at the 5' position of a pyrimidine or a 7-position of a purine. These are discussed in more detail below;

(iii) nonphosphate linkages at the termini. Thus, preferred NRM's include Non-phosphate linkages, e.g., a linkage of 4 atoms which confers greater resistance to cleavage than does a phosphate bond. Examples include 3' CH2—NCH$_3$—O—CH2-5' and 3' CH2—NH—(O═)—CH2-5';

(iv) 3'-bridging thiophosphates and 5'-bridging thiophosphates. Thus, preferred NRM's can inclued these structures;

(v) L-RNA, 2'-5' likages, inverted linkages, a-nucleosides. Thus, other preferred NRM's include: L nucleosides and dimeric nucleotides derived from L-nucleosides; 2'-5' phosphate, non-phosphate and modified phosphate linkages (e.g., thiophosphates, phosphoramidates and boronophosphates); dimers having inverted linkages, e.g., 3'-3' or 5'-5' linkages; monomers having an alpha linkage at the 1' site on the sugar, e.g., the structures described herein having an alpha linkage;

(vi) conjugate groups. Thus, preferred NRM's can include e.g., a targeting moiety or a conjugated ligand described herein conjugated with the monomer, e.g., through the sugar, base, or backbone;

(vi) abasic linkages. Thus, preferred NRM's can include an abasic monomer, e.g., an abasic monomer as described herein (e.g., a nucleobaseless monomer); an aromatic or heterocyclic or polyheterocyclic aromatic monomer as described herein; and (vii) 5'-phosphonates and 5'-phosphate prodrugs. Thus, preferred NRM's include monomers, preferably at the terminal position, e.g., the 5' position, in which one or more atoms of the phosphate group is derivatized with a protecting group, which protecting group or groups, are removed as a result of the action of a component in the subject's body, e.g, a carboxyesterase or an enzyme present in the subject's body. E.g., a phosphate prodrug in which a carboxy esterase cleaves the protected molecule resulting in the production of a thioate anion which attacks a carbon adjacent to the O of a phosphate and resulting in the production of an unprotected phosphate.

One or more different NRM modifications can be introduced into an iRNA agent or into a sequence of an iRNA agent. An NRM modification can be used more than once in a sequence or in an iRNA agent. As some NRM's interfere with hybridization the total number incorporated, should be such that acceptable levels of iRNA agent duplex formation are maintained.

In some embodiments NRM modifications are introduced into the terminal the cleavage site or in the cleavage region of a sequence (a sense strand or sequence) which does not target a desired sequence or gene in the subject. This can reduce off-target silencing.

Chiral $S_p$ Thioates

A modification can include the alteration, e.g., replacement, of one or both of the non-linking (X and Y) phosphate oxygens and/or of one or more of the linking (W and Z) phosphate oxygens. Formula X below depicts a phosphate moiety linking two sugar/sugar surrogate-base moities, $SB_1$ and $SB_2$.

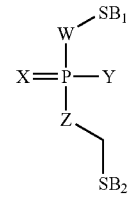

FORMULA X

In certain embodiments, one of the non-linking phosphate oxygens in the phosphate backbone moiety (X and Y) can be replaced by any one of the following: S, Se, $BR_3$ (R is hydrogen, alkyl, aryl, etc.), C (i.e., an alkyl group, an aryl group, etc.), H, $NR_2$ (R is hydrogen, alkyl, aryl, etc.), or OR (R is alkyl or aryl). The phosphorus atom in an unmodified phosphate group is achiral. However, replacement of one of the non-linking oxygens with one of the above atoms or groups of atoms renders the phosphorus atom chiral; in other words a phosphorus atom in a phosphate group modified in this way is a stereogenic center. The stereogenic phosphorus atom can possess either the "R" configuration (herein $R_p$) or the "S" configuration (herein $S_p$). Thus if 60% of a population of stereogenic phosphorus atoms have the $R_p$ configuration, then the remaining 40% of the population of stereogenic phosphorus atoms have the $S_p$ configuration.

In some embodiments, iRNA agents, having phosphate groups in which a phosphate non-linking oxygen has been replaced by another atom or group of atoms, may contain a population of stereogenic phosphorus atoms in which at least about 50% of these atoms (e.g., at least about 60% of these atoms, at least about 70% of these atoms, at least about 80% of these atoms, at least about 90% of these atoms, at least about 95% of these atoms, at least about 98% of these atoms, at least about 99% of these atoms) have the $S_p$ configuration. Alternatively, iRNA agents having phosphate groups in which a phosphate non-linking oxygen has been replaced by another atom or group of atoms may contain a population of stereogenic phosphorus atoms in which at least about 50% of these atoms (e.g., at least about 60% of these atoms, at least about 70% of these atoms, at least about 80% of these atoms, at least about 90% of these atoms, at least about 95% of these atoms, at least about 98% of these atoms, at least about 99% of these atoms) have the $R_P$ configuration. In other embodiments, the population of stereogenic phosphorus atoms may have the $S_p$ configuration and may be substantially free of stereogenic phosphorus atoms having the $R_p$ configuration. In still other embodiments, the population of stereogenic phosphorus atoms may have the $R_p$ configuration and may be substantially free of stereogenic phosphorus atoms having the $S_p$ configuration. As used herein, the phrase "substantially free of stereogenic phosphorus atoms having the $R_p$ configuration" means that moieties containing stereogenic phosphorus atoms having the $R_p$ configuration cannot be detected by conventional methods known in the art (chiral HPLC, $^1$H NMR analysis using chiral shift reagents, etc.). As used herein, the phrase "substantially free of stereogenic phosphorus atoms having the $S_p$ configuration" means that moieties containing stereogenic phosphorus atoms having the $S_p$ configuration cannot be detected by conventional methods known in the art (chiral HPLC, $^1$H NMR analysis using chiral shift reagents, etc.).

In a preferred embodiment, modified iRNA agents contain a phosphorothioate group, i.e., a phosphate groups in which a phosphate non-linking oxygen has been replaced by a sulfur atom. In an especially preferred embodiment, the population of phosphorothioate stereogenic phosphorus atoms may have the $S_p$ configuration and be substantially free of stereogenic phosphorus atoms having the $R_p$ configuration.

Phosphorothioates may be incorporated into iRNA agents using dimers e.g., formulas X-1 and X-2. The former can be used to introduce phosphorothioate

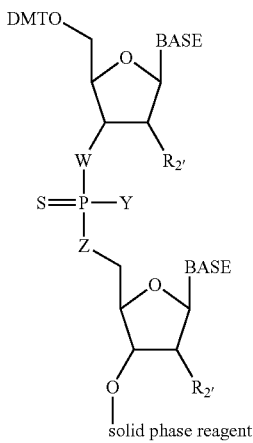

solid phase reagent

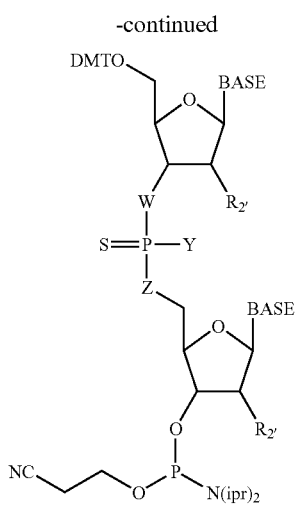

at the 3' end of a strand, while the latter can be used to introduce this modification at the 5' end or at a position that occurs e.g., 1, 2, 3, 4, 5, or 6 nucleotides from either end of the strand. In the above formulas, Y can be 2-cyanoethoxy, W and Z can be O, $R_2$, can be, e.g., a substituent that can impart the C-3 endo configuration to the sugar (e.g., OH, F, $OCH_3$), DMT is dimethoxytrityl, and "BASE" can be a natural, unusual, or a universal base.

X-1 and X-2 can be prepared using chiral reagents or directing groups that can result in phosphorothioate-containing dimers having a population of stereogenic phosphorus atoms having essentially only the $R_p$ configuration (i.e., being substantially free of the $S_p$ configuration) or only the $S_p$ configuration (i.e., being substantially free of the $R_p$ configuration). Alternatively, dimers can be prepared having a population of stereogenic phosphorus atoms in which about 50% of the atoms have the $R_p$ configuration and about 50% of the atoms have the $S_p$ configuration. Dimers having stereogenic phosphorus atoms with the $R_p$ configuration can be identified and separated from dimers having stereogenic phosphorus atoms with the $S_p$ configuration using e.g., enzymatic degradation and/or conventional chromatography techniques.

Cationic Groups

Modifications can also include attachment of one or more cationic groups to the sugar, base, and/or the phosphorus atom of a phosphate or modified phosphate backbone moiety. A cationic group can be attached to any atom capable of substitution on a natural, unusual or universal base. A preferred position is one that does not interfere with hybridization, i.e., does not interfere with the hydrogen bonding interactions needed for base pairing. A cationic group can be attached e.g., through the C2' position of a sugar or analogous position in a cyclic or acyclic sugar surrogate. Cationic groups can include e.g., protonated amino groups, derived from e.g., O-AMINE (AMINE=$NH_2$; alkylamino, dialkylamino, heterocyclyl, arylamino, diaryl amino, heteroaryl amino, or diheteroaryl amino, ethylene diamine, polyamino); aminoalkoxy, e.g., $O(CH_2)_n$AMINE, (e.g., AMINE=$NH_2$; alkylamino, dialkylamino, heterocyclyl, arylamino, diaryl amino, heteroaryl amino, or diheteroaryl amino, ethylene diamine, polyamino); amino (e.g. $NH_2$; alkylamino, dialkylamino, heterocyclyl, arylamino, diaryl amino, heteroaryl amino, diheteroaryl amino, or amino acid); or $NH(CH_2CH_2NH)_nCH_2CH_2$-AMINE (AMINE=$NH_2$; alkylamino, dialkylamino, heterocyclyl, arylamino, diaryl amino, heteroaryl amino, or diheteroaryl amino).

Nonphosphate Linkages

Modifications can also include the incorporation of nonphosphate linkages at the 5' and/or 3' end of a strand. Examples of nonphosphate linkages which can replace the phosphate group include methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino. Preferred replacements include the methyl phosphonate and hydroxylamino groups.

3'-bridging thiophosphates and 5'-bridging thiophosphates; locked-RNA, 2'-5' likages, inverted linkages, a-nucleosides; conjugate groups; abasic linkages; and 5-phosphonates and 5'-phosphate prodrugs Referring to formula X above, modifications can include replacement of one of the bridging or liking phosphate oxygens in the phosphate backbone moiety (W and Z). Unlike the situation where only one of X or Y is altered, the phosphorus center in the phosphorodithioates is achiral which precludes the formation of iRNA agents containing a stereogenic phosphorus atom.

Modifications can also include linking two sugars via a phosphate or modified phosphate group through the 2' position of a first sugar and the 5' position of a second sugar. Also contemplated are inverted linkages in which both a first and second sugar are eached linked through the respective 3' positions. Modified RNA's can also include "abasic" sugars, which lack a nucleobase at C-1'. The sugar group can also contain one or more carbons that possess the opposite stereochemical configuration than that of the corresponding carbon in ribose. Thus, a modified iRNA agent can include nucleotides containing e.g., arabinose, as the sugar. In another subset of this modification, the natural, unusual, or universal base may have the α-configuration. Modifications can also include L-RNA.

Modifications can also include 5'-phosphonates, e.g., P(O)(O$^-$)$_2$—X—C$^{5'}$-sugar (X=CH2, CF2, CHF and 5'-phosphate prodrugs, e.g., P(O)[OCH2CH2SC(O)R]$_2$CH$_2$C$^{5'}$-sugar. In the latter case, the prodrug groups may be decomposed via reaction first with carboxy esterases. The remaining ethyl thiolate group via intramolecular S$_N$2 displacement can depart as episulfide to afford the underivatized phosphate group.

Modification can also include the addition of conjugating groups described elseqhere herein, which are preferably attached to an iRNA agent through any amino group available for conjugation.

Nuclease resistant modifications include some which can be placed only at the terminus and others which can go at any position. Generally the modifications that can inhibit hybridization so it is preferably to use them only in terminal regions, and preferrable to not use them at the cleavage site or in the cleavage region of an sequence which targets a subject sequence or gene. The can be used anywhere in a sense sequence, provided that sufficient hybridization between the two sequences of the iRNA agent is maintained. In some embodiments it is desirable to put the NRM at the cleavage site or in the cleavage region of a sequence which does not target a subject sequence or gene, as it can minimize off-target silencing.

In addition, an iRNA agent described herein can have an overhang which does not form a duplex structure with the other sequence of the iRNA agent—it is an overhang, but it does hybridize, either with itself, or with another nucleic acid, other than the other sequence of the iRNA agent.

In most cases, the nuclease-resistance promoting modifications will be distributed differently depending on whether the sequence will target a sequence in the subject (often, referred to as an anti-sense sequence) or will not target a sequence in the subject (often referred to as a sense sequence). If a sequence is to target a sequence in the subject, modifications which interfere with or inhibit endonuclease cleavage should not be inserted in the region which is subject to RISC mediated cleavage, e.g., the cleavage site or the cleavage region (As described in Elbashir et al., 2001, Genes and Dev. 15: 188, hereby incorporated by reference, cleavage of the target occurs about in the middle of a 20 or 21 nt guide RNA, or about 10 or 11 nucleotides upstream of the first nucleotide which is complementary to the guide sequence. As used herein cleavage site refers to the nucleotide on either side of the cleavage site, on the target or on the iRNA agent strand which hybridizes to it. Cleavage region means an nucleotide with 1, 2, or 3 nucleotides of the cleave site, in either direction.)

Such modifications can be introduced into the terminal regions, e.g., at the terminal position or with 2, 3, 4, or 5 positions of the terminus, of a sequence which targets or a sequence which does not target a sequence in the subject.

An iRNA agent can have a first and a second strand chosen from the following:

a first strand which does not target a sequence and which has an NRM modification at or within 1, 2, 3, 4, 5, or 6 positions from the 3' end;

a first strand which does not target a sequence and which has an NRM modification at or within 1, 2, 3, 4, 5, or 6 positions from the 5' end;

a first strand which does not target a sequence and which has an NRM modification at or within 1, 2, 3, 4, 5, or 6 positions from the 3' end and which has a NRM modification at or within 1, 2, 3, 4, 5, or 6 positions from the 5' end;

a first strand which does not target a sequence and which has an NRM modification at the cleavage site or in the cleavage region;

a first strand which does not target a sequence and which has an NRM modification at the cleavage site or in the cleavage region and one or more of an NRM modification at or within 1, 2, 3, 4, 5, or 6 positions from the 3' end, a NRM modification at or within 1, 2, 3, 4, 5, or 6 positions from the 5' end, or NRM modifications at or within 1, 2, 3, 4, 5, or 6 positions from both the 3' and the 5' end; and a second strand which targets a sequence and which has an NRM modification at or within 1, 2, 3, 4, 5, or 6 positions from the 3' end;

a second strand which targets a sequence and which has an NRM modification at or within 1, 2, 3, 4, 5, or 6 positions from the 5' end (5' end NRM modifications are preferentially not at the terminus but rather at a position 1, 2, 3, 4, 5, or 6 away from the 5' terminus of an antisense strand);

a second strand which targets a sequence and which has an NRM modification at or within 1, 2, 3, 4, 5, or 6 positions from the 3' end and which has a NRM modification at or within 1, 2, 3, 4, 5 or 6 positions from the 5' end;

a second strand which targets a sequence and which preferably does not have an an NRM modification at the cleavage site or in the cleavage region;

a second strand which targets a sequence and which does not have an NRM modification at the cleavage site or in the cleavage region and one or more of an NRM modification at or within 1, 2, 3, 4, 5, or 6 positions from the 3' end, a NRM modification at or within 1, 2, 3, 4, 5, or 6 positions from the 5' end, or NRM modifications at or within 1, 2, 3, 4, 5, or 6 positions from both the 3' and the 5' end (5' end NRM modifications are preferentially not at the terminus but rather at a position 1, 2, 3, 4, 5, or 6 away from the 5' terminus of an antisense strand).

An iRNA agent can also target two sequences and can have a first and second strand chosen from:

a first strand which targets a sequence and which has an NRM modification at or within 1, 2, 3, 4, 5, or 6 positions from the 3' end;

a first strand which targets a sequence and which has an NRM modification at or within 1, 2, 3, 4, 5, or 6 positions from the 5' end (5' end NRM modifications are preferentially not at the terminus but rather at a position 1, 2, 3, 4, 5, or 6 away from the 5' terminus of an antisense strand);

a first strand which targets a sequence and which has an NRM modification at or within 1, 2, 3, 4, 5, or 6 positions from the 3' end and which has a NRM modification at or within 1, 2, 3, 4, 5, or 6 positions from the 5' end;

a first strand which targets a sequence and which preferably does not have an an NRM modification at the cleavage site or in the cleavage region;

a first strand which targets a sequence and which dose not have an NRM modification at the cleavage site or in the cleavage region and one or more of an NRM modification at or within 1, 2, 3, 4, 5, or 6 positions from the 3' end, a NRM modification at or within 1, 2, 3, 4, 5, or 6 positions from the 5' end, or NRM modifications at or within 1, 2, 3, 4, 5, or 6 positions from both the 3' and the 5' end (5' end NRM modifications are preferentially not at the terminus but rather at a position 1, 2, 3, 4, 5, or 6 away from the 5' terminus of an antisense strand) and a second strand which targets a sequence and which has an NRM modification at or within 1, 2, 3, 4, 5, or 6 positions from the 3' end;

a second strand which targets a sequence and which has an NRM modification at or within 1, 2, 3, 4, 5, or 6 positions from the 5' end (5' end NRM modifications are preferentially not at the terminus but rather at a position 1, 2, 3, 4, 5, or 6 away from the 5' terminus of an antisense strand);

a second strand which targets a sequence and which has an NRM modification at or within 1, 2, 3, 4, 5, or 6 positions from the 3' end and which has a NRM modification at or within 1, 2, 3, 4, 5, or 6 positions from the 5' end;

a second strand which targets a sequence and which preferably does not have an NRM modification at the cleavage site or in the cleavage region;

a second strand which targets a sequence and which dose not have an NRM modification at the cleavage site or in the cleavage region and one or more of an NRM modification at or within 1, 2, 3, 4, 5, or 6 positions from the 3' end, a NRM modification at or within 1, 2, 3, 4, 5, or 6 positions from the 5' end, or NRM modifications at or within 1, 2, 3, 4, 5, or 6 positions from both the 3' and the 5' end (5' end NRM modifications are preferentially not at the terminus but rather at a position 1, 2, 3, 4, 5, or 6 away from the 5' terminus of an antisense strand).

Ribose Mimics

In one aspect, the invention features a ribose mimic, or an iRNA agent which incorporates a ribose mimic, such as those described herein and those described in copending co-owned U.S. Provisional Application Ser. No. 60/454,962, filed on Mar. 13, 2003, which is hereby incorporated by reference.

In addition, the invention includes iRNA agents having a ribose mimic and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA agent having an architecture or structure described herein, an iRNA associated with an amphipathic delivery agent described herein, an iRNA associated with a drug delivery module described herein, an iRNA agent administered as described herein, or an iRNA agent formulated as described herein, which also incorporates a ribose mimic.

Thus, an aspect of the invention features an iRNA agent that includes a secondary hydroxyl group, which can increase efficacy and/or confer nuclease resistance to the agent. Nucleases, e.g., cellular nucleases, can hydrolyze nucleic acid phosphodiester bonds, resulting in partial or complete degradation of the nucleic acid. The secondary hydroxy group confers nuclease resistance to an iRNA agent by rendering the iRNA agent less prone to nuclease degradation relative to an iRNA which lacks the modification. While not wishing to be bound by theory, it is believed that the presence of a secondary hydroxyl group on the iRNA agent can act as a structural mimic of a 3' ribose hydroxyl group, thereby causing it to be less susceptible to degradation.

The secondary hydroxyl group refers to an "OH" radical that is attached to a carbon atom substituted by two other carbons and a hydrogen. The secondary hydroxyl group that confers nuclease resistance as described above can be part of any acyclic carbon-containing group. The hydroxyl may also be part of any cyclic carbon-containing group, and preferably one or more of the following conditions is met (1) there is no ribose moiety between the hydroxyl group and the terminal phosphate group or (2) the hydroxyl group is not on a sugar moiety which is coupled to a base. The hydroxyl group is located at least two bonds (e.g., at least three bonds away, at least four bonds away, at least five bonds away, at least six bonds away, at least seven bonds away, at least eight bonds away, at least nine bonds away, at least ten bonds away, etc.) from the terminal phosphate group phosphorus of the iRNA agent. In preferred embodiments, there are five intervening bonds between the terminal phosphate group phosphorus and the secondary hydroxyl group.

Preferred iRNA agent delivery modules with five intervening bonds between the terminal phosphate group phosphorus and the secondary hydroxyl group have the following structure (see formula Y below):

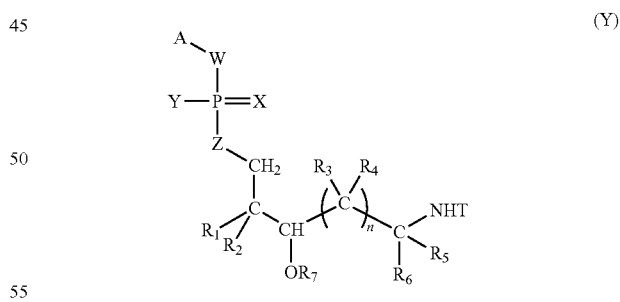

(Y)

Referring to formula Y, A is an iRNA agent, including any iRNA agent described herein. The iRNA agent may be connected directly or indirectly (e.g., through a spacer or linker) to "W" of the phosphate group. These spacers or linkers can include e.g., $-(CH_2)_n-$, $-(CH_2)_nN-$, $-(CH_2)_nO-$, $-(CH_2)_nS-$, $O(CH_2CH_2O)_nCH_2CH_2OH$ (e.g., n=3 or 6), abasic sugars, amide, carboxy, amine, oxyamine, oxyimine, thioether, disulfide, thiourea, sulfonamide, or morpholino, or biotin and fluorescein reagents.

The iRNA agents can have a terminal phosphate group that is unmodified (e.g., W, X, Y, and Z are O) or modified. In a modified phosphate group, W and Z can be independently NH, O, or S; and X and Y can be independently S, Se, BH$_3$—, C$_1$-C$_6$ alkyl, C$_6$-C$_{10}$ aryl, H, O, O—, alkoxy or amino (including alkylamino, arylamino, etc.). Preferably, W, X and Z are O and Y is S.

R$_1$ and R$_3$ are each, independently, hydrogen; or C$_1$-C$_{100}$ alkyl, optionally substituted with hydroxyl, amino, halo, phosphate or sulfate and/or may be optionally inserted with N, O, S, alkenyl or alkynyl.

R$_2$ is hydrogen; C$_1$-C$_{100}$ alkyl, optionally substituted with hydroxyl, amino, halo, phosphate or sulfate and/or may be optionally inserted with N, O, S, alkenyl or alkynyl; or, when n is 1, R$_2$ may be taken together with R$_4$ or R$_6$ to form a ring of 5-12 atoms.

R$_4$ is hydrogen; C$_1$-C$_{100}$ alkyl, optionally substituted with hydroxyl, amino, halo, phosphate or sulfate and/or may be optionally inserted with N, O, S, alkenyl or alkynyl; or, when n is 1, R$_4$ may be taken together with R$_2$ or R$_5$ to form a ring of 5-12 atoms.

R$_5$ is hydrogen, C$_1$-C$_{100}$ alkyl optionally substituted with hydroxyl, amino, halo, phosphate or sulfate and/or may be optionally inserted with N, O, S, alkenyl or alkynyl; or, when n is 1, R$_5$ may be taken together with R$_4$ to form a ring of 5-12 atoms.

R$_6$ is hydrogen, C$_1$-C$_{100}$ alkyl, optionally substituted with hydroxyl, amino, halo, phosphate or sulfate and/or may be optionally inserted with N, O, S, alkenyl or alkynyl, or, when n is 1, R$_6$ may be taken together with R$_2$ to form a ring of 6-10 atoms;

R$_7$ is hydrogen, C$_1$-C$_{100}$ alkyl, or C(O)(CH$_2$)$_q$C(O)NHR$_9$; T is hydrogen or a functional group; n and q are each independently 1-100; R$_8$ is C$_1$-C$_{10}$ alkyl or C$_6$-C$_{10}$ aryl; and R$_9$ is hydrogen, C1-C10 alkyl, C6-C10 aryl or a solid support agent.

Preferred embodiments may include one of more of the following subsets of iRNA agent delivery modules.

In one subset of RNAi agent delivery modules, A can be connected directly or indirectly through a terminal 3' or 5' ribose sugar carbon of the RNA agent.

In another subset of RNAi agent delivery modules, X, W, and Z are O and Y is S.

In still yet another subset of RNAi agent delivery modules, n is 1, and R$_2$ and R$_6$ are taken together to form a ring containing six atoms and R$_4$ and R$_5$ are taken together to form a ring containing six atoms. Preferably, the ring system is a trans-decalin. For example, the RNAi agent delivery module of this subset can include a compound of Formula (Y-1):

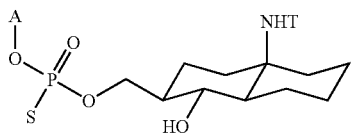

The functional group can be, for example, a targeting group (e.g., a steroid or a carbohydrate), a reporter group (e.g., a fluorophore), or a label (an isotopically labelled moiety). The targeting group can further include protein binding agents, endothelial cell targeting groups (e.g., RGD peptides and mimetics), cancer cell targeting groups (e.g., folate Vitamin B12, Biotin), bone cell targeting groups (e.g., bisphosphonates, polyglutamates, polyaspartates), multivalent mannose (for e.g., macrophage testing), lactose, galactose, N-acetyl-galactosamine, monoclonal antibodies, glycoproteins, lectins, melanotropin, or thyrotropin.

As can be appreciated by the skilled artisan, methods of synthesizing the compounds of the formulae herein will be evident to those of ordinary skill in the art. The synthesized compounds can be separated from a reaction mixture and further purified by a method such as column chromatography, high pressure liquid chromatography, or recrystallization. Additionally, the various synthetic steps may be performed in an alternate sequence or order to give the desired compounds. Synthetic chemistry transformations and protecting group methodologies (protection and deprotection) useful in synthesizing the compounds described herein are known in the art and include, for example, those such as described in R. Larock, *Comprehensive Organic Transformations*, VCH Publishers (1989); T. W. Greene and P. G. M. Wuts, *Protective Groups in Organic Synthesis,* 2d. Ed., John Wiley and Sons (1991); L. Fieser and M. Fieser, *Fieser and Fieser's Reagents for Organic Synthesis*, John Wiley and Sons (1994); and L. Paquette, ed., *Encyclopedia of Reagents for Organic Synthesis*, John Wiley and Sons (1995), and subsequent editions thereof.

Ribose Replacement Monomer Subunits iRNA agents can be modified in a number of ways which can optimize one or more characteristics of the iRNA agent. In one aspect, the invention features a ribose replacement monomer subunit (RRMS), or a an iRNA agent which incorporates a RRMS, such as those described herein and those described in one or more of U.S. Provisional Application Ser. No. 60/493,986, filed on Aug. 8, 2003, which is hereby incorporated by reference; U.S. Provisional Application Ser. No. 60/494,597, filed on Aug. 11, 2003, which is hereby incorporated by reference; U.S. Provisional Application Ser. No. 60/506,341, filed on Sep. 26, 2003, which is hereby incorporated by reference; and in U.S. Provisional Application Ser. No. 60/158,453, filed on Nov. 7, 2003, which is hereby incorporated by reference.

In addition, the invention includes iRNA agents having a RRMS and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA agent having an architecture or structure described herein, an iRNA associated with an amphipathic delivery agent described herein, an iRNA associated with a drug delivery module described herein, an iRNA agent administered as described herein, or an iRNA agent formulated as described herein, which also incorporates a RRMS.

The ribose sugar of one or more ribonucleotide subunits of an iRNA agent can be replaced with another moiety, e.g., a non-carbohydrate (preferably cyclic) carrier. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The carriers further include (i) at least two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" as used herein refers to a constituent ring atom of the cyclic carrier, e.g., a carbon atom or a heteroatom (distinct from an atom which provides a backbone attachment point), that connects a selected moiety. The moiety can be, e.g., a ligand, e.g., a targeting or delivery moiety, or a moiety which alters a physical property, e.g., lipophilicity, of an iRNA agent. Optionally, the selected moiety is connected by an intervening tether to the cyclic carrier. Thus, it will include a functional group, e.g., an amino group, or generally, provide a bond, that is suitable for incorporation or tethering of another chemical entity, e.g., a ligand to the constituent ring.

Incorporation of one or more RRMSs described herein into an RNA agent, e.g., an iRNA agent, particularly when tethered to an appropriate entity, can confer one or more new properties to the RNA agent and/or alter, enhance or modulate one or more existing properties in the RNA molecule. E.g., it can alter one or more of lipophilicity or nuclease resistance. Incorporation of one or more RRMSs described herein into an iRNA agent can, particularly when the RRMS is tethered to an appropriate entity, modulate, e.g., increase, binding affinity of an iRNA agent to a target mRNA, change the geometry of the duplex form of the iRNA agent, alter distribution or target the iRNA agent to a particular part of the body, or modify the interaction with nucleic acid binding proteins (e.g., during RISC formation and strand separation).

Accordingly, in one aspect, the invention features, an iRNA agent preferably comprising a first strand and a second strand, wherein at least one subunit having a formula (R-1) is incorporated into at least one of said strands.

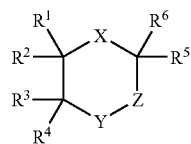
(R-1)

Referring to formula (R-1), X is $N(CO)R^7$, $NR^7$ or $CH_2$; Y is $NR^8$, O, S, $CR^9R^{10}$, or absent; and Z is $CR^{11}R^{12}$ or absent.

Each of $R^1$, $R^2$, $R^3$, $R^4$, $R^9$, and $R^{10}$ is, independently, H, $OR^a$, $OR^b$, $(CH_2)_nOR^a$, or $(CH_2)_nOR^b$, provided that at least one of $R^1$, $R^2$, $R^3$, $R^4$, $R^9$, and $R^{10}$ is $OR^a$ or $OR^b$ and that at least one of $R^1$, $R^2$, $R^3$, $R^4$, $R^9$, and $R^{10}$ is $(CH_2)_nOR^a$, or $(CH_2)_nOR^b$ (when the RRMS is terminal, one of $R^1$, $R^2$, $R^3$, $R^4$, $R^9$, and $R^{10}$ will include $R^a$ and one will include $R^b$; when the RRMS is, internal, two of $R^1$, $R^2$, $R^3$, $R^4$, $R^9$, and $R^{10}$ will each include an $R^b$); further provided that preferably $OR^a$ may only be present with $(CH_2)_nOR^b$ and $(CH_2)_nOR^a$ may only be present with $OR^b$.

Each of $R^5$, $R^6$, $R^{11}$, and $R^{12}$ is, independently, H, $C_1$-$C_6$ alkyl optionally substituted with 1-3 $R^{13}$, or $C(O)NHR^7$; or $R^5$ and $R^{11}$ together are $C_3$-$C_8$ cycloalkyl optionally substituted with $R^{14}$.

$R^7$ is $C_1$-$C_{20}$ alkyl substituted with $NR^cR^d$; $R^8$ is $C_1$-$C_6$ alkyl; $R^{13}$ is hydroxy, $C_1$-$C_4$ alkoxy, or halo; and $R^{14}$ is $NR^cR^7$.

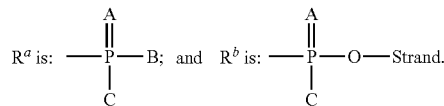

Each of A and C is, independently, O or S.

B is OH, O−, or

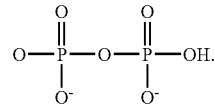

$R^c$ is H or C1-C6 alkyl; $R^d$ is H or a ligand; and n is 1-4.

In a preferred embodiment the ribose is replaced with a pyrroline scaffold, and X is $N(CO)R^7$ or $NR^7$, Y is $CR^9R^{10}$, and Z is absent.

In other preferred embodiments the ribose is replaced with a piperidine scaffold, and X is $N(CO)R^7$ or $NR^7$, Y is $CR^9R^{10}$, and Z is $CR^{11}R^{12}$.

In other preferred embodiments the ribose is replaced with a piperazine scaffold, and X is $N(CO)R^7$ or $NR^7$, Y is $NR^8$, and Z is $CR^{11}R^{12}$.

In other preferred embodiments the ribose is replaced with a morpholino scaffold, and X is $N(CO)R^7$ or $NR^7$, Y is O, and Z is $CR^{11}R^{12}$.

In other preferred embodiments the ribose is replaced with a decalin scaffold, and X is $CH_2$; Y is $CR^9R^{10}$; and Z is $CR^{11}R^{12}$; and $R^5$ and $R^{11}$ together are $C^6$ cycloalkyl.

In other preferred embodiments the ribose is replaced with a decalin/indane scaffold and, and X is $CH_2$; Y is $CR^9R^{10}$; and Z is $CR^{11}R^{12}$; and $R^5$ and $R^{11}$ together are $C^5$ cycloalkyl.

In other preferred embodiments, the ribose is replaced with a hydroxyproline scaffold.

RRMSs described herein may be incorporated into any double-stranded RNA-like molecule described herein, e.g., an iRNA agent. An iRNA agent may include a duplex comprising a hybridized sense and antisense strand, in which the antisense strand and/or the sense strand may include one or more of the RRMSs described herein. An RRMS can be introduced at one or more points in one or both strands of a double-stranded iRNA agent. An RRMS can be placed at or near (within 1, 2, or 3 positions) of the 3' or 5' end of the sense strand or at near (within 2 or 3 positions of) the 3' end of the antisense strand. In some embodiments it is preferred to not have an RRMS at or near (within 1, 2, or 3 positions of) the 5' end of the antisense strand. An RRMS can be internal, and will preferably be positioned in regions not critical for antisense binding to the target.

In an embodiment, an iRNA agent may have an RRMS at (or within 1, 2, or 3 positions of) the 3' end of the antisense strand. In an embodiment, an iRNA agent may have an RRMS at (or within 1, 2, or 3 positions of) the 3' end of the antisense strand and at (or within 1, 2, or 3 positions of) the 3' end of the sense strand. In an embodiment, an iRNA agent may have an RRMS at (or within 1, 2, or 3 positions of) the 3' end of the antisense strand and an RRMS at the 5' end of the sense strand, in which both ligands are located at the same end of the iRNA agent.

In certain embodiments, two ligands are tethered, preferably, one on each strand and are hydrophobic moieties. While not wishing to be bound by theory, it is believed that pairing of the hydrophobic ligands can stabilize the iRNA agent via intermolecular van der Waals interactions.

In an embodiment, an iRNA agent may have an RRMS at (or within 1, 2, or 3 positions of) the 3' end of the antisense strand and an RRMS at the 5' end of the sense strand, in which both RRMSs may share the same ligand (e.g., cholic acid) via connection of their individual tethers to separate positions on the ligand. A ligand shared between two proximal RRMSs is referred to herein as a "hairpin ligand."

In other embodiments, an iRNA agent may have an RRMS at the 3' end of the sense strand and an RRMS at an internal position of the sense strand. An iRNA agent may have an RRMS at an internal position of the sense strand; or may have an RRMS at an internal position of the antisense strand; or may have an RRMS at an internal position of the sense strand and an RRMS at an internal position of the antisense strand.

In preferred embodiments the iRNA agent includes a first and second sequences, which are preferably two separate molecules as opposed to two sequences located on the same strand, have sufficient complementarity to each other to hybridize (and thereby form a duplex region), e.g., under physiological conditions, e.g., under physiological conditions but not in contact with a helicase or other unwinding enzyme.

It is preferred that the first and second sequences be chosen such that the ds iRNA agent includes a single strand or unpaired region at one or both ends of the molecule. Thus, a ds iRNA agent contains first and second sequences, preferable paired to contain an overhang, e.g., one or two 5' or 3' overhangs but preferably a 3' overhang of 2-3 nucleotides. Most embodiments will have a 3' overhang. Preferred sRNA agents will have single-stranded overhangs, preferably 3' overhangs, of 1 or preferably 2 or 3 nucleotides in length at each end. The overhangs can be the result of one strand being longer than the other, or the result of two strands of the same length being staggered. 5' ends are preferably phosphorylated.

Figure 4:
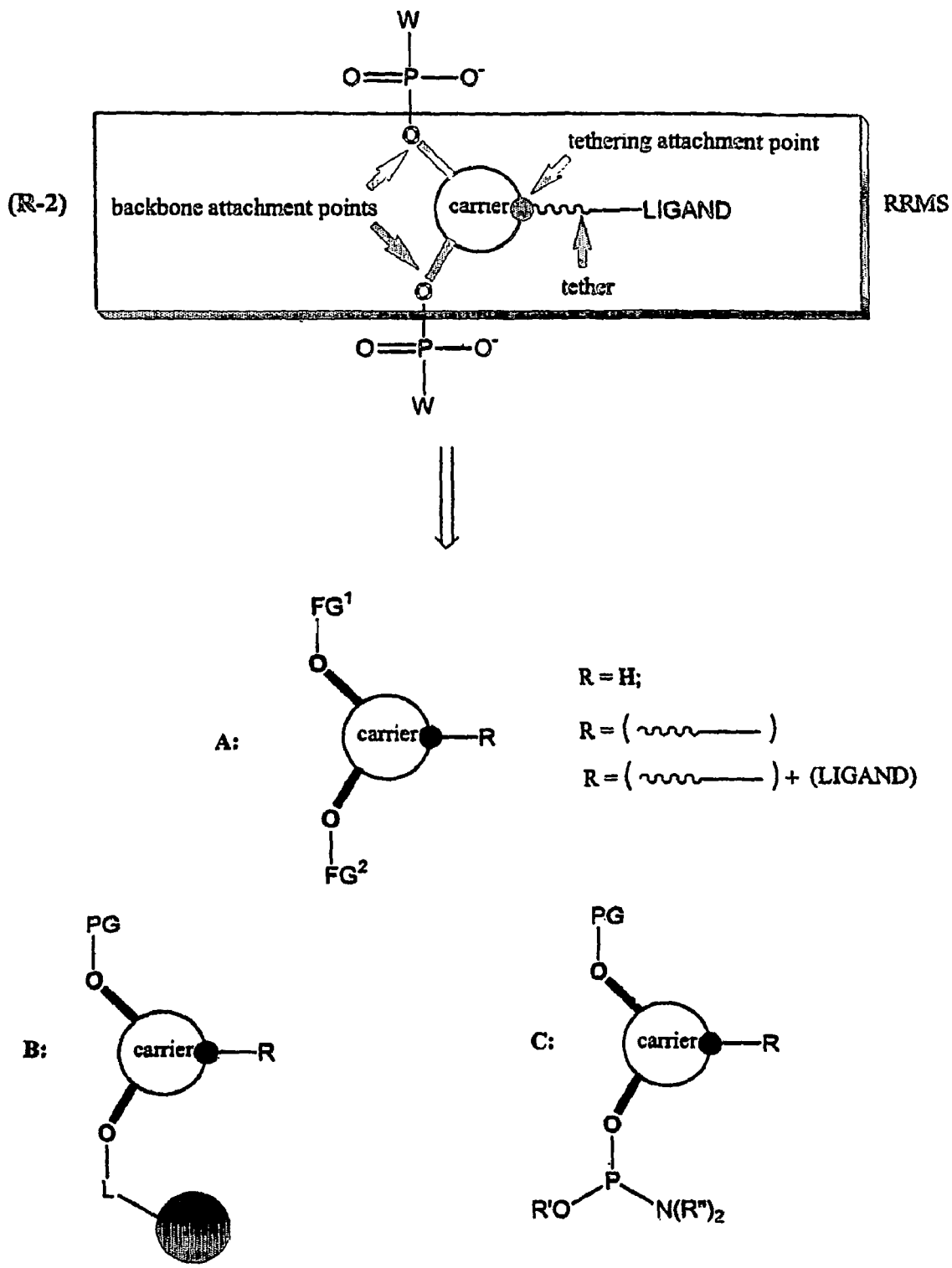
FIG. 4 is a general synthetic scheme for incorporation of RRMS monomers into an oligonucleotide.

An RNA agent, e.g., an iRNA agent, containing a preferred, but nonlimiting RRMS is presented as formula (R-2) in FIG. 4. The carrier includes two "backbone attachment points" (hydroxyl groups), a "tethering attachment point," and a ligand, which is connected indirectly to the carrier via an intervening tether. The RRMS may be the 5' or 3' terminal subunit of the RNA molecule, i.e., one of the two "W" groups may be a hydroxyl group, and the other "W" group may be a chain of two or more unmodified or modified ribonucleotides. Alternatively, the RRMS may occupy an internal position, and both "W" groups may be one or more unmodified or modified ribonucleotides. More than one RRMS may be present in a RNA molecule, e.g., an iRNA agent.

The modified RNA molecule of formula (R-2) can be obtained using oligonucleotide synthetic methods known in the art. In a preferred embodiment, the modified RNA molecule of formula (II) can be prepared by incorporating one or more of the corresponding RRMS monomer compounds (RRMS monomers, see, e.g., A, B, and C in FIG. 4) into a growing sense or antisense strand, utilizing, e.g., phosphoramidite or H-phosphonate coupling strategies.

The RRMS monomers generally include two differently functionalized hydroxyl groups ($OFG^1$ and $OFG^2$ above), which are linked to the carrier molecule (see A in FIG. 4), and a tethering attachment point. As used herein, the term "functionalized hydroxyl group" means that the hydroxyl proton has been replaced by another substituent. As shown in representative structures B and C, one hydroxyl group ($OFG^1$) on the carrier is functionalized with a protecting group (PG). The other hydroxyl group ($OFG^2$) can be functionalized with either (1) a liquid or solid phase synthesis support reagent (solid circle) directly or indirectly through a linker, L, as in B, or (2) a phosphorus-containing moiety, e.g., a phosphoramidite as in C. The tethering attachment point may be connected to a hydrogen atom, a tether, or a tethered ligand at the time that the monomer is incorporated into the growing sense or antisense strand (see R in Scheme 1). Thus, the tethered ligand can be, but need not be attached to the monomer at the time that the monomer is incorporated into the growing strand. In certain embodiments, the tether, the ligand or the tethered ligand may be linked to a "precursor" RRMS after a "precursor" RRMS monomer has been incorporated into the strand.

The ($OFG^1$) protecting group may be selected as desired, e.g., from T. W. Greene and P. G. M. Wuts, *Protective Groups in Organic Synthesis*, 2d. Ed., John Wiley and Sons (1991). The protecting group is preferably stable under amidite synthesis conditions, storage conditions, and oligonucleotide synthesis conditions. Hydroxyl groups, —OH, are nucleophilic groups (i.e., Lewis bases), which react through the oxygen with electrophiles (i.e., Lewis acids). Hydroxyl groups in which the hydrogen has been replaced with a protecting group, e.g., a triarylmethyl group or a trialkylsilyl group, are essentially unreactive as nucleophiles in displacement reactions. Thus, the protected hydroxyl group is useful in preventing e.g., homocoupling of compounds exemplified by structure C during oligonucleotide synthesis. A preferred protecting group is the dimethoxytrityl group.

When the $OFG^2$ in B includes a linker, e.g., a long organic linker, connected to a soluble or insoluble support reagent, solution or solid phase synthesis techniques can be employed to build up a chain of natural and/or modified ribonucleotides once $OFG^1$ is deprotected and free to react as a nucleophile with another nucleoside or monomer containing an electrophilic group (e.g., an amidite group). Alternatively, a natural or modified ribonucleotide or oligoribonucleotide chain can be coupled to monomer C via an amidite group or H-phosphonate group at $OFG^2$. Subsequent to this operation, $OFG^1$ can be deblocked, and the restored nucleophilic hydroxyl group can react with another nucleoside or monomer containing an electrophilic group (see FIG. 1). R' can be substituted or unsubstituted alkyl or alkenyl. In preferred embodiments, R' is methyl, allyl or 2-cyanoethyl. R" may a $C_1$-$C_{10}$ alkyl group, preferably it is a branched group containing three or more carbons, e.g., isopropyl.

$OFG^2$ in B can be hydroxyl functionalized with a linker, which in turn contains a liquid or solid phase synthesis support reagent at the other linker terminus. The support reagent can be any support medium that can support the monomers described herein. The monomer can be attached to an insoluble support via a linker, L, which allows the monomer (and the growing chain) to be solubilized in the solvent in which the support is placed. The solubilized, yet immobilized, monomer can react with reagents in the surrounding solvent; unreacted reagents and soluble by-products can be readily washed away from the solid support to which the monomer or monomer-derived products is attached. Alternatively, the monomer can be attached to a soluble support moiety, e.g., polyethylene glycol (PEG) and liquid phase synthesis techniques can be used to build up the chain. Linker and support medium selection is within skill of the art. Generally the linker may be —C(O)(CH$_2$)$_q$C(O)—, or —C(O)(CH$_2$)$_q$S—, preferably, it is oxalyl, succinyl or thioglycolyl. Standard control pore glass solid phase synthesis supports can not be used in conjunction with fluoride labile 5' silyl protecting groups because the glass is degraded by fluoride with a significant reduction in the amount of full-length product. Fluoride-stable polystyrene based supports or PEG are preferred.

Preferred carriers have the general formula (R-3) provided below. (In that structure preferred backbone attachment points can be chosen from $R^1$ or $R^2$; $R^3$ or $R^4$; or $R^9$ and $R^{10}$ if Y is $CR^9R^{10}$ (two positions are chosen to give two backbone attachment points, e.g., $R^1$ and $R^4$, or $R^4$ and $R^9$. Preferred tethering attachment points include $R^7$; $R^5$ or $R^6$ when X is $CH_2$. The carriers are described below as an entity, which can be incorporated into a strand. Thus, it is understood that the structures also encompass the situations wherein one (in the case of a terminal position) or two (in the case of an internal position) of the attachment points, e.g., $R^1$ or $R^2$; $R^3$ or $R^4$; or $R^9$ or $R^{10}$ (when Y is $CR^9R^{10}$), is connected to the phosphate, or modified phosphate, e.g., sulfur containing, backbone. E.g., one of the above-named R groups can be —$CH_2$—, wherein one bond is connected to the carrier and one to a backbone atom, e.g., a linking oxygen or a central phosphorus atom.)

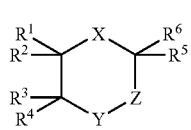

(R-3)

X is $N(CO)R^7$, $NR^7$ or $CH_2$; Y is $NR^8$, O, S, $CR^9R^{10}$; and Z is $CR^{11}R^{12}$ or absent.

Each of $R^1$, $R^2$, $R^3$, $R^4$, $R^9$, and $R^{10}$ is, independently, H, $OR^a$, or $(CH_2)_nOR^b$, provided that at least two of $R^1$, $R^2$, $R^3$, $R^4$, $R^9$, and $R^{10}$ are $OR^a$ and/or $(CH_2)_nOR^b$.

Each of $R^5$, $R^6$, $R^{11}$, and $R^{12}$ is, independently, a ligand, H, $C_1$-$C_6$ alkyl optionally substituted with 1-3 $R^{13}$, or $C(O)NHR^7$; or $R^5$ and $R^{11}$ together are $C_3$-$C_8$ cycloalkyl optionally substituted with $R^{14}$.

$R^7$ is H, a ligand, or $C_1$-$C_{20}$ alkyl substituted with $NR^cR^d$; $R^8$ is H or $C_1$-$C_6$ alkyl; $R^{13}$ is hydroxy, $C_1$-$C_4$ alkoxy, or halo; $R^{14}$ is $NR^cR^7$; $R^{15}$ is $C_1$-$C_6$ alkyl optionally substituted with cyano, or $C_2$-$C_6$ alkenyl; $R^{16}$ is $C_1$-$C_{10}$ alkyl; and $R^{17}$ is a liquid or solid phase support reagent.

L is —$C(O)(CH_2)_qC(O)$—, or —$C(O)(CH_2)_qS$—; $R^a$ is $CAr_3$; $R^b$ is $P(O)(O^-)H$, $P(OR^{15})N(R^{16})_2$ or L-$R^{17}$; $R^c$ is H or $C_1$-$C_6$ alkyl; and $R^d$ is H or a ligand.

Each Ar is, independently, $C_6$-$C_{10}$ aryl optionally substituted with $C_1$-$C_4$ alkoxy; n is 1-4; and q is 0-4.

Exemplary carriers include those in which, e.g., X is $N(CO)R^7$ or $NR^7$, Y is $CR^9R^{10}$, and Z is absent; or X is $N(CO)R^7$ or $NR^7$, Y is $CR^9R^{10}$, and Z is $CR^{11}R^{12}$; or X is $N(CO)R^7$ or $NR^7$, Y is $NR^8$, and Z is $CR^{11}R^{12}$; or X is $N(CO)R^7$ or $NR^7$, Y is O, and Z is $CR^{11}R^{12}$; or X is $CH_2$; Y is $CR^9R^{10}$; Z is $CR^{11}R^{12}$, and $R^5$ and $R^{11}$ together form $C_6$ cycloalkyl (H, z=2), or the indane ring system, e.g., X is $CH_2$; Y is $CR^9R^{10}$; Z is $CR^{11}R^{12}$, and $R^5$ and $R^{11}$ together form $C_5$ cycloalkyl (H, z=1).

In certain embodiments, the carrier may be based on the pyrroline ring system or the 3-hydroxyproline ring system, e.g., X is $N(CO)R^7$ or $NR^7$, Y is $CR^9R^{10}$, and Z is absent (D). $OFG^1$ is preferably attached to a primary carbon, e.g., an exocyclic alkylene

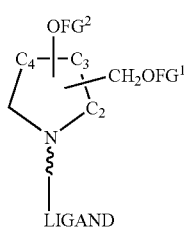

D group, e.g., a methylene group, connected to one of the carbons in the five-membered ring (—$CH_2OFG^1$ in D). $OFG^2$ is preferably attached directly to one of the carbons in the five-membered ring (—$OFG^2$ in D). For the pyrroline-based carriers, —$CH_2OFG^1$ may be attached to C-2 and $OFG^2$ may be attached to C-3; or —$CH_2OFG^1$ may be attached to C-3 and $OFG^2$ may be attached to C-4. In certain embodiments, $CH_2OFG^1$ and $OFG^2$ may be geminally substituted to one of the above-referenced carbons. For the 3-hydroxyproline-based carriers, —$CH_2OFG^1$ may be attached to C-2 and $OFG^2$ may be attached to C-4. The pyrroline- and 3-hydroxyproline-based monomers may therefore contain linkages (e.g., carbon-carbon bonds) wherein bond rotation is restricted about that particular linkage, e.g. restriction resulting from the presence of a ring. Thus, $CH_2OFG^1$ and $OFG^2$ may be cis or trans with respect to one another in any of the pairings delineated above Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included. The tethering attachment point is preferably nitrogen.

In certain embodiments, the carrier may be based on the piperidine ring system (E), e.g., X is $N(CO)R^7$ or $NR^7$, Y is $CR^9R^{10}$, and Z is $CR^{11}R^{12}$. $OFG^1$ is preferably

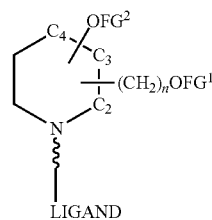

E attached to a primary carbon, e.g., an exocyclic alkylene group, e.g., a methylene group (n=1) or ethylene group (n=2), connected to one of the carbons in the six-membered ring [—$(CH_2)_nOFG^1$ in E]. $OFG^2$ is preferably attached directly to one of the carbons in the six-membered ring (—$OFG^2$ in E). —$(CH_2)_nOFG^1$ and $OFG^2$ may be disposed in a geminal manner on the ring, i.e., both groups may be attached to the same carbon, e.g., at C-2, C-3, or C-4. Alternatively, —$(CH_2)_n$ $OFG^1$ and $OFG^2$ may be disposed in a vicinal manner on the ring, i.e., both groups may be attached to adjacent ring carbon atoms, e.g., —$(CH_2)_nOFG^1$ may be attached to C-2 and $OFG^2$ may be attached to C-3; —$(CH_2)_n$ $OFG^1$ may be attached to C-3 and $OFG^2$ may be attached to C-2; —$(CH_2)_nOFG^1$ may be attached to C-3 and $OFG^2$ may be attached to C-4; or —$(CH_2)_nOFG^1$ may be attached to C-4 and $OFG^2$ may be attached to C-3. The piperidine-based monomers may therefore contain linkages (e.g., carbon-carbon bonds) wherein bond rotation is restricted about that particular linkage, e.g. restriction resulting from the presence of a ring. Thus, —$(CH_2)_nOFG^1$ and $OFG^2$ may be cis or trans with respect to one another in any of the pairings delineated above. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included. The tethering attachment point is preferably nitrogen.

In certain embodiments, the carrier may be based on the piperazine ring system (F), e.g., X is N(CO)$R^7$ or $NR^7$, Y is $NR^8$, and Z is $CR^{11}R^{12}$, or the morpholine ring system (G), e.g., X is N(CO)$R^7$ or $NR^7$, Y is O, and Z is $CR^{11}R^{12}$. $OFG^1$ is preferably

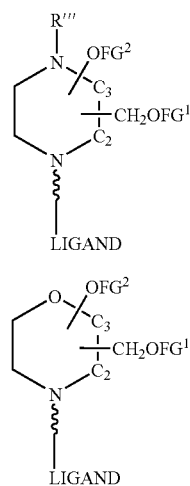

attached to a primary carbon, e.g., an exocyclic alkylene group, e.g., a methylene group, connected to one of the carbons in the six-membered ring (—$CH_2OFG^1$ in F or G). $OFG^2$ is preferably attached directly to one of the carbons in the six-membered rings (—$OFG^2$ in F or G). For both F and G, —$CH_2OFG^1$ may be attached to C-2 and $OFG^2$ may be attached to C-3; or vice versa. In certain embodiments, $CH_2OFG^1$ and $OFG^2$ may be geminally substituted to one of the above-referenced carbons. The piperazine- and morpholine-based monomers may therefore contain linkages (e.g., carbon-carbon bonds) wherein bond rotation is restricted about that particular linkage, e.g. restriction resulting from the presence of a ring. Thus, $CH_2OFG^1$ and $OF^2$ may be cis or trans with respect to one another in any of the pairings delineated above. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included. R'" can be, e.g., $C_1$-$C_6$ alkyl, preferably $CH_3$. The tethering attachment point is preferably nitrogen in both F and G.

In certain embodiments, the carrier may be based on the decalin ring system, e.g., X is $CH_2$; Y is $CR^9R^{10}$; Z is $CR^{11}R^{12}$, and $R^5$ and $R^{11}$ together form $C_6$ cycloalkyl (H, z=2), or the indane ring system, e.g., X is $CH_2$; Y is $CR^9R^{10}$; Z is $CR^{11}R^{12}$, and $R^5$ and $R^{11}$ together form $C_5$ cycloalkyl (H, z=1). $OFG^1$ is preferably attached to a primary carbon,

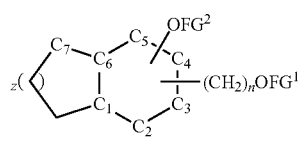

e.g., an exocyclic methylene group (n=1) or ethylene group (n=2) connected to one of C-2, C-3, C-4, or C-5 [—$(CH_2)_n$ $OFG^1$ in H]. $OFG^2$ is preferably attached directly to one of C-2, C-3, C-4, or C-5 (—$OFG^2$ in H). —$(CH_2)_nOFG^1$ and $OFG^2$ may be disposed in a geminal manner on the ring, i.e., both groups may be attached to the same carbon, e.g., at C-2, C-3, C-4, or C-5. Alternatively, —$(CH_2)_nOFG^1$ and $OFG^2$ may be disposed in a vicinal manner on the ring, i.e., both groups may be attached to adjacent ring carbon atoms, e.g., —$(CH_2)_nOFG^1$ may be attached to C-2 and $OFG^2$ may be attached to C-3; —$(CH_2)_nOFG^1$ may be attached to C-3 and $OFG^2$ may be attached to C-2; —$(CH_2)_nOFG^1$ may be attached to C-3 and $OFG^2$ may be attached to C-4; or —$(CH_2)_n$ $OFG^1$ may be attached to C-4 and $OFG^2$ may be attached to C-3; —$(CH_2)_nOFG^1$ may be attached to C-4 and $OFG^2$ may be attached to C-5; or —$(CH_2)_nOFG^1$ may be attached to C-5 and $OFG^2$ may be attached to C-4. The decalin or indane-based monomers may therefore contain linkages (e.g., carbon-carbon bonds) wherein bond rotation is restricted about that particular linkage, e.g. restriction resulting from the presence of a ring. Thus, —$(CH_2)_nOFG^1$ and $OFG^2$ may be cis or trans with respect to one another in any of the pairings delineated above. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included. In a preferred embodiment, the substituents at C-1 and C-6 are trans with respect to one another. The tethering attachment point is preferably C-6 or C-7.

Other carriers may include those based on 3-hydroxyproline (J). Thus, —$(CH_2)_nOFG^1$ and $OFG^2$ may be cis or trans with respect to one another. Accordingly, all cis/trans isomers are expressly included. The monomers may also contain one or more asymmetric centers

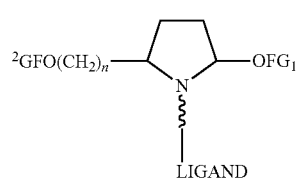

and thus occur as racemates and racemic mixtures, single enantiomers, individual diastereomers and diastereomeric mixtures. All such isomeric forms of the monomers are expressly included. The tethering attachment point is preferably nitrogen.

Figure 5:
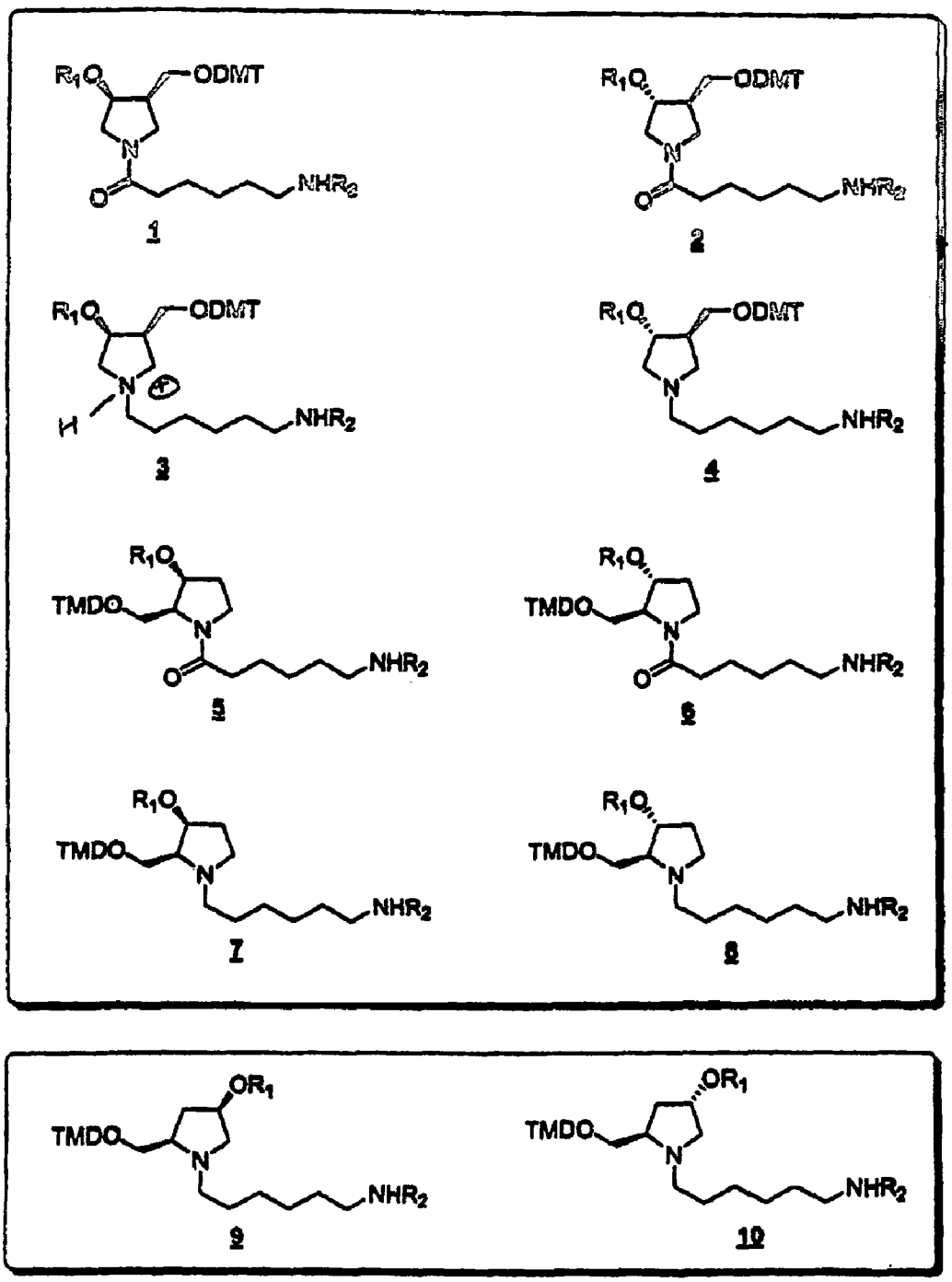
FIG. 5 is a table of representative RRMS carriers. Panel 1 shows pyrroline-based RRMSs; panel 2 shows 3-hydroxyproline-based RRMSs; panel 3 shows piperidine-based RRMSs; panel 4 shows morpholine and piperazine-based RRMSs; and panel 5 shows decalin-based RRMSs. R1 is succinate or phosphoramidate and R2 is H or a conjugate ligand.
Figure 5:
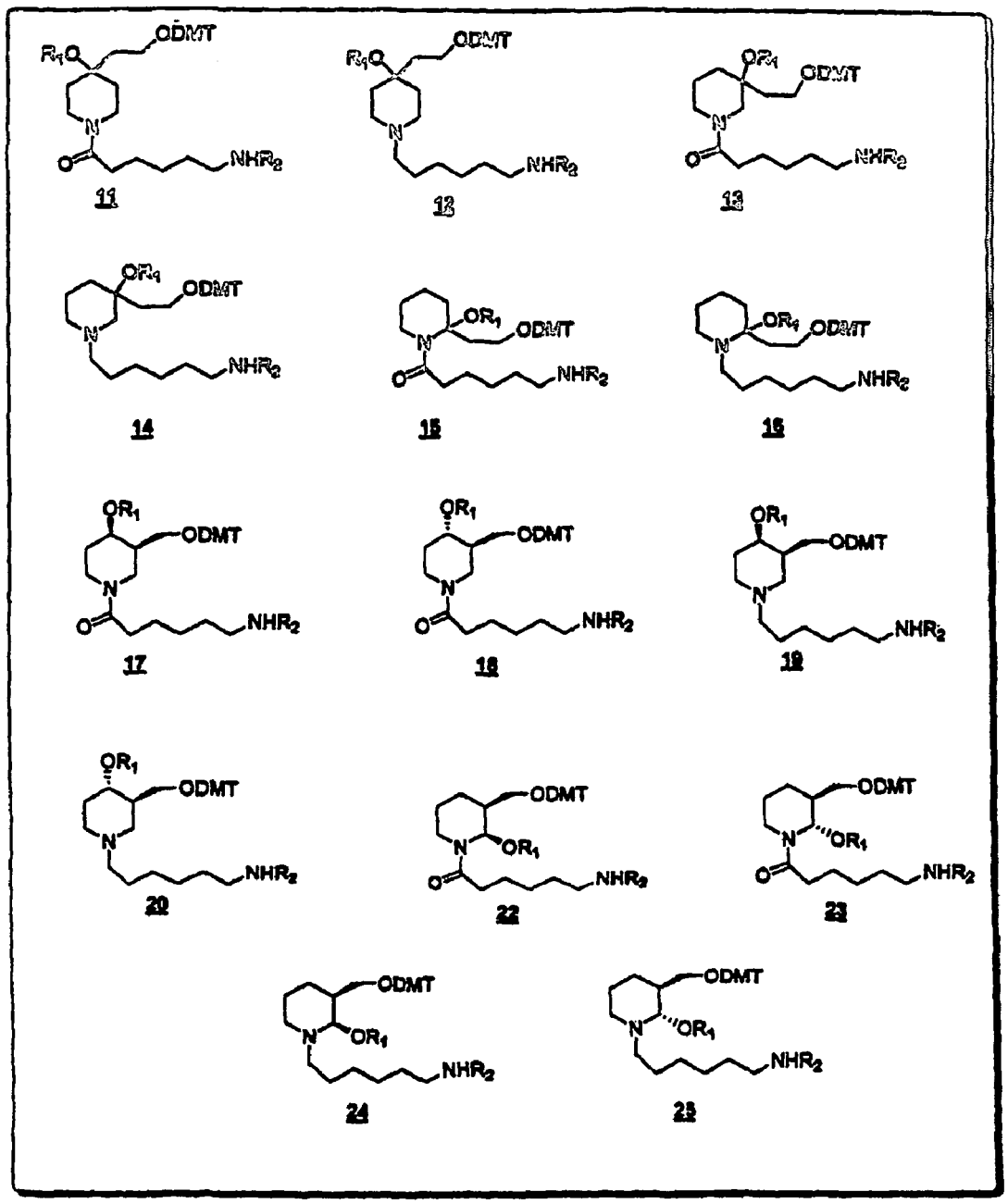
Figure 5:
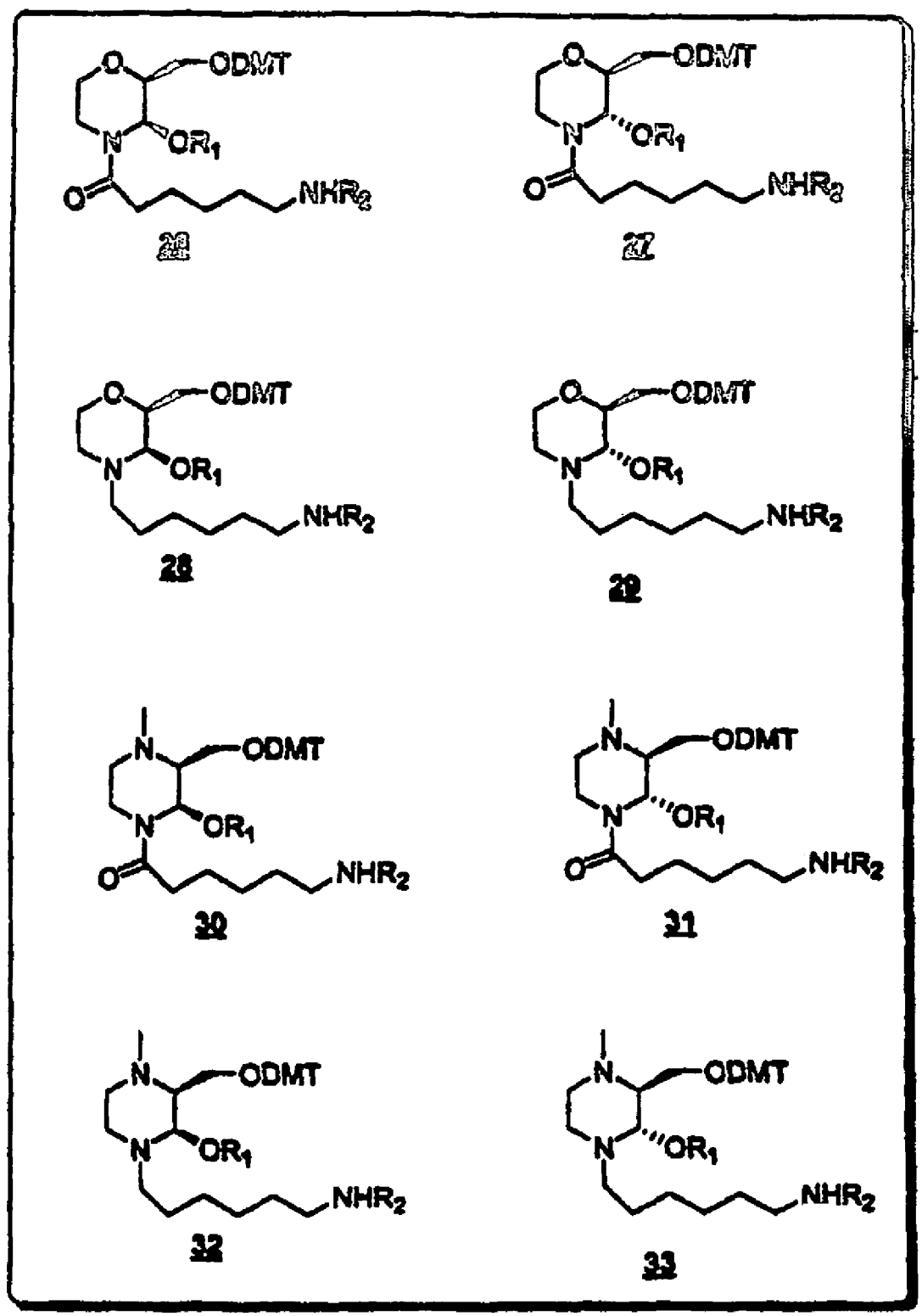
Figure 5:
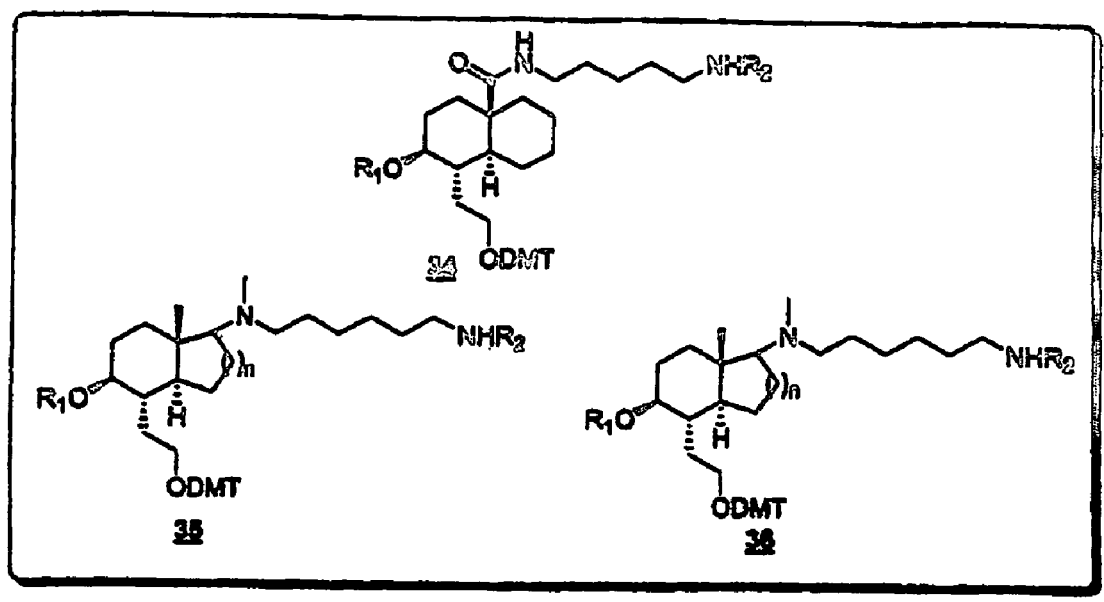

Representative carriers are shown in FIG. 5.

In certain embodiments, a moiety, e.g., a ligand may be connected indirectly to the carrier via the intermediacy of an intervening tether. Tethers are connected to the carrier at the tethering attachment point (TAP) and may include any $C_1$-$C_{100}$ carbon-containing moiety, (e.g. $C_1$-$C_{75}$, $C_1$-$C_{50}$, $C_1$-$C_{20}$, $C_1$-$C_{10}$, $C_1$-$C_6$), preferably having at least one nitrogen atom. In preferred embodiments, the nitrogen atom forms part of a terminal amino group on the tether, which may serve as a connection point for the ligand. Preferred tethers (underlined) include TAP-$(CH_2)_nNH_2$; TAP-C(O)$(CH_2)_nNH_2$; or TAP-NR""$(CH_2)_nNH_2$, in which n is 1-6 and R"" is $C_1$-$C_6$ alkyl. and $R^d$ is hydrogen or a ligand. In other embodiments, the nitrogen may form part of a terminal oxyamino group, e.g., —$ONH_2$, or hydrazino group, —$NHNH_2$. The tether may optionally be substituted, e.g., with hydroxy, alkoxy, perhaloalkyl, and/or optionally inserted with one or more additional heteroatoms, e.g., N, O, or S. Preferred tethered ligands may include, e.g., TAP-$(CH_2)_n$NH(LIGAND), TAP-C(O)$(CH_2)_n$NH(LIGAND), or TAP-NR""$(CH_2)_n$NH (LIGAND); TAP-$(CH_2)_n$ONH(LIGAND), TAP-C(O)$(CH_2)_n$ONH(LIGAND), or TAP-NR ""$(CH_2)_n$ONH(LIGAND); TAP-$(CH_2)_n$NHNH$_2$(LIGAND), TAP-C(O)$(CH_2)_n$NHNH$_2$ (LIGAND), or TAP-NR ""$(CH_2)_n$NHNH$_2$(LIGAND).

In other embodiments the tether may include an electrophilic moiety, preferably at the terminal position of the tether. Preferred electrophilic moieties include, e.g., an aldehyde, alkyl halide, mesylate, tosylate, nosylate, or brosylate, or an activated carboxylic acid ester, e.g. an NHS ester, or a pentafluorophenyl ester. Preferred tethers (underlined) include TAP-$(CH_2)$CHO; TAP-C(O)$(CH_2)_n$CHO; or TAP-NR"" $(CH_2)_n$CHO, in which n is 1-6 and R"" is $C_1$-$C_6$ alkyl; or TAP-$(CH_2)_n$C(O)ONHS; TAP-C(O)$(CH_2)_n$C(O)ONHS; or TAP-NR""$(CH_2)_n$C(O)ONHS, in which n is 1-6 and R"" is $C_1$-$C_6$ alkyl; TAP-$(CH_2)_n$C(O)OC$_6$F$_5$; TAP-C(O)$(CH_2)_n$C (O)OC$_6$F$_5$; or TAP-NR""$(CH_2)_n$C(O)OC$_6$F$_5$, in which n is 1-6 and R"" is $C_1$-$C_6$ alkyl; or —$(CH_2)$CH$_2$LG, TAP-C(O) $(CH_2)_n$CH$_2$LG; or TAP-NR""$(CH_2)_n$CH$_2$LG in which n is 1-6 and R"" is $C_1$-$C_6$ alkyl (LG can be a leaving group, e.g., halide, mesylate, tosylate, nosylate, brosylate). Tethering can be carried out by coupling a nucleophilic group of a ligand, e.g., a thiol or amino group with an electrophilic group on the tether.

Tethered Entities

A wide variety of entities can be tethered to an iRNA agent, e.g., to the carrier of an RRMS. Examples are described below in the context of an RRMS but that is only preferred, entities can be coupled at other points to an iRNA agent.

Preferred moieties are ligands, which are coupled, preferably covalently, either directly or indirectly via an intervening tether, to the RRMS carrier. In preferred embodiments, the ligand is attached to the carrier via an intervening tether. As discussed above, the ligand or tethered ligand may be present on the RRMS monomer when the RRMS monomer is incorporated into the growing strand. In some embodiments, the ligand may be incorporated into a "precursor" RRMS after a "precursor" RRMS monomer has been incorporated into the growing strand. For example, an RRMS monomer having, e.g., an amino-terminated tether (i.e., having no associated ligand), e.g., TAP-$(CH_2)_n$NH$_2$ may be incorporated into a growing sense or antisense strand. In a subsequent operation, i.e., after incorporation of the precursor monomer into the strand, a ligand having an electrophilic group, e.g., a pentafluorophenyl ester or aldehyde group, can subsequently be attached to the precursor RRMS by coupling the electrophilic group of the ligand with the terminal nucleophilic group of the precursor RRMS tether.

In preferred embodiments, a ligand alters the distribution, targeting or lifetime of an iRNA agent into which it is incorporated. In preferred embodiments a ligand provides an enhanced affinity for a selected target, e.g, molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Preferred ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a cancer cell, endothelial cell, bone cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The ligand can increase the uptake of the iRNA agent into the cell by activating an inflammatory response, for example. Exemplary ligands that would have such an effect include tumor necrosis factor alpha (TNFalpha), interleukin-1 beta, or gamma interferon.

In one aspect, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. Preferably, the target tissue is the liver, preferably parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a seru protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

In another aspect, the ligand is a cell-permeation agent, preferably a helical cell-permeation agent. Preferably, the agent is amphipathic., An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long (see Table 1, for example).

TABLE 1

Exemplary Cell Permeation Peptides

| Cell Permeation Peptide | Amino acid Sequence | Reference |
|---|---|---|
| Penetratin | RQIKIWFQNRRMKWKK (SEQ ID NO: 6737) | Derossi et al., J. Biol. Chem. 269: 10444, 1994 |
| Tat fragment (48-60) | GRKKRRQRRRPPQC (SEQ ID NO: 6738) | Vives et al., J. Biol. Chem., 272: 16010, 1997 |
| Signal Sequence-based peptide | GALFLGWLGAAGSTMGAWSQPKKKRKV (SEQ ID NO: 6738) | Chaloin et al., Biochem. Biophys. Res. Commun., 243: 601, 1998 |
| PVEC | LLIILRRRIRKQAHAHSK (SEQ ID NO: 6739) | Elmquist et al., Exp. Cell Res., 269: 237, 2001 |
| Transportan | GWTLNSAGYLLKINLKALAALAKKIL (SEQ ID NO: 6740) | Pooga et al., FASEB J., 12: 67, 1998 |
| Amphiphilic model peptide | KLALKLALKALKAALKLA (SEQ ID NO: 6741) | Oehlke et al., Mol. Ther., 2: 339, 2000 |
| $Arg_9$ | RRRRRRRRR (SEQ ID NO: 6742) | Mitchell et al., J. Pept. Res., 56: 318, 2000 |

TABLE 1-continued

Exemplary Cell Permeation Peptides

| Cell Permeation Peptide | Amino acid Sequence | Reference |
|---|---|---|
| Bacterial cell wall permeating | KFFKFFKFFK (SEQ ID NO: 6743) | |
| LL-37 | LLGDFFRKSKEKIGKEFKRIVQRIKDFLRN LVPRTES (SEQ ID NO: 6744) | |
| Cecropin P1 | SWLSKTAKKLENSAKKRISEGIAIAIQGGPR (SEQ ID NO: 6745) | |
| α-defensin | ACYCRIPACIAGERRYGTCIYQGRLWAFCC (SEQ ID NO: 6746) | |
| b-defensin | DHYNCVSSGGQCLYSACPIFTKIQGTCYR GKAKCCK (SEQ ID NO: 6747) | |
| Bactenecin | RKCRIVVIRVCR (SEQ ID NO: 6748) | |
| PR-39 | RRRPRPPYLPRPRPPPFFPPRLPPRIPPGFPP RFPPRFPGKR-NH2 (SEQ ID NO: 6749) | |
| Indolicidin | ILPWKWPWWPWRR-NH2 (SEQ ID NO: 6750) | |

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:6751). An RFGF analogue (e.g., amino acid sequence AALLPVLLAAP (SEQ ID NO:6752)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:6753)) and the Drosophila Antennapedia protein (RQIKIWFQNRRMKWKK (SEQ ID NO:6754)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Preferably the peptide or peptidomimetic tethered to an iRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide moiety can be used to target a tumor cell, such as an endothelial tumor cell or a breast cancer tumor cell (Zitzmann et al., Cancer Res., 62:5139-43, 2002). An RGD peptide can facilitate targeting of an iRNA agent to tumors of a variety of other tissues, including the lung, kidney, spleen, or liver (Aoki et al., Cancer Gene Therapy 8:783-787, 2001). The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_v\beta_3$ (Haubner et al., Jour. Nucl. Med., 42:326-336, 2001).

Peptides that target markers enriched in proliferating cells can be used. E.g., RGD containing peptides and peptidomimetics can target cancer cells, in particular cells that exhibit an $\alpha_v\beta_3$ integrin. Thus, one could use RGD peptides, cyclic peptides containing RGD, RGD peptides that include D-amino acids, as well as synthetic RGD mimics. In addition to RGD, one can use other moieties that target the $\alpha_v$-$\beta_3$ integrin ligand. Generally, such ligands can be used to control proliferating cells and angiogeneis. Preferred conjugates of this type include an iRNA agent that targets PECAM-1, VEGF, or other cancer gene, e.g., a cancer gene described herein.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

In one embodiment, a targeting peptide tethered to an RRMS can be an amphipathic α-helical peptide. Exemplary amphipathic α-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, $H_2A$ peptides, Xenopus peptides, esculentinis-1, and caerins. A number of factors will preferably be considered to maintain the integrity of helix stability. For example, a maximum number of helix stabilization residues will be utilized (e.g., leu, ala, or lys), and a minimum number helix destabilization residues will be utilized (e.g., proline, or cyclic monomeric units. The capping residue will be considered (for example Gly is an exemplary N-capping residue and/or C-terminal amidation can be used to provide an extra H-bond to stabilize the helix. Formation of salt bridges between residues with opposite charges, separated by i±3, or i±4 positions can provide stability. For example, cationic residues such as lysine, arginine, homo-arginine, ornithine or histidine can form salt bridges with the anionic residues glutamate or aspartate.

Peptide and petidomimetic ligands include those having naturally occurring or modified peptides, e.g., D or L peptides; α,β, or γ peptides; N-methyl peptides; azapeptides; peptides having one or more amide, i.e., peptide, linkages replaced with one or more urea, thiourea, carbamate, or sulfonyl urea linkages; or cyclic peptides.

Methods for Making iRNA Agents iRNA agents can include modified or non-naturally occurring bases, e.g., bases described in copending and coowned U.S. Provisional Application Ser. No. 60/463,772, filed on Apr. 17, 2003, which is hereby incorporated by reference and/or in copending and coowned U.S. Provisional Application Ser. No. 60/465,802, filed on Apr. 25, 2003, which is hereby incorporated by reference. Monomers and iRNA agents which include such bases can be made by the methods found in U.S. Provisional Application Ser. No. 60/463,772, filed on Apr. 17, 2003, and/or in U.S. Provisional Application Ser. No. 60/465,802, filed on Apr. 25, 2003.

In addition, the invention includes iRNA agents having a modified or non-naturally occurring base and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA agent having an architecture or structure described herein, an iRNA associated with an amphipathic delivery agent described herein, an iRNA associated with a drug delivery module described herein, an iRNA agent administered as described herein, or an iRNA agent formulated as described herein, which also incorporates a modified or non-naturally occurring base.

The synthesis and purification of oligonucleotide peptide conjugates can be performed by established methods. See, for example, Trufert et al., Tetrahedron, 52:3005, 1996; and Manoharan, "Oligonucleotide Conjugates in Antisense Technology," in *Antisense Drug Technology*, ed. S. T. Crooke, Marcel Dekker, Inc., 2001.

In one embodiment of the invention, a peptidomimetic can be modified to create a constrained peptide that adopts a distinct and specific preferred conformation, which can increase the potency and selectivity of the peptide. For example, the constrained peptide can be an azapeptide (Gante, Synthesis, 405-413, 1989). An azapeptide is synthesized by replacing the α-carbon of an amino acid with a nitrogen atom without changing the structure of the amino acid side chain. For example, the azapeptide can be synthesized by using hydrazine in traditional peptide synthesis coupling methods, such as by reacting hydrazine with a "carbonyl donor," e.g., phenylchloroformate.

In one embodiment of the invention, a peptide or peptidomimetic (e.g., a peptide or peptidomimetic tethered to an RRMS) can be an N-methyl peptide. N-methyl peptides are composed of N-methyl amino acids, which provide an additional methyl group in the peptide backbone, thereby potentially providing additional means of resistance to proteolytic cleavage. N-methyl peptides can by synthesized by methods known in the art (see, for example, Lindgren et al., Trends Pharmacol. Sci. 21:99, 2000; *Cell Penetrating Peptides: Processes and Applications*, Langel, ed., CRC Press, Boca Raton, Fla., 2002; Fische et al., Bioconjugate. Chem. 12: 825, 2001; Wander et al., J. Am. Chem. Soc., 124:13382, 2002). For example, an Ant or Tat peptide can be an N-methyl peptide.

In one embodiment of the invention, a peptide or peptidomimetic (e.g., a peptide or peptidomimetic tethered to an RRMS) can be a β-peptide. β-peptides form stable secondary structures such as helices, pleated sheets, turns and hairpins in solutions. Their cyclic derivatives can fold into nanotubes in the solid state. β-peptides are resistant to degradation by proteolytic enzymes. β-peptides can be synthesized by methods known in the art. For example, an Ant or Tat peptide can be a β-peptide.

In one embodiment of the invention, a peptide or peptidomimetic (e.g., a peptide or peptidomimetic tethered to an RRMS) can be a oligocarbamate. Oligocarbamate peptides are internalized into a cell by a transport pathway facilitated by carbamate transporters. For example, an Ant or Tat peptide can be an oligocarbamate.

In one embodiment of the invention, a peptide or peptidomimetic (e.g., a peptide or peptidomimetic tethered to an RRMS) can be an oligourea conjugate (or an oligothiourea conjugate), in which the amide bond of a peptidomimetic is replaced with a urea moiety. Replacement of the amide bond provides increased resistance to degradation by proteolytic enzymes, e.g., proteolytic enzymes in the gastrointestinal tract. In one embodiment, an oligourea conjugate is tethered to an iRNA agent for use in oral delivery. The backbone in each repeating unit of an oligourea peptidomimetic can be extended by one carbon atom in comparison with the natural amino acid. The single carbon atom extension can increase peptide stability and lipophilicity, for example. An oligourea peptide can therefore be advantageous when an iRNA agent is directed for passage through a bacterial cell wall, or when an iRNA agent must traverse the blood-brain barrier, such as for the treatment of a neurological disorder. In one embodiment, a hydrogen bonding unit is conjugated to the oligourea peptide, such as to create an increased affinity with a receptor. For example, an Ant or Tat peptide can be an oligourea conjugate (or an oligothiourea conjugate).

The siRNA peptide conjugates of the invention can be affiliated with, e.g., tethered to, RRMSs occurring at various positions on an iRNA agent. For example, a peptide can be terminally conjugated, on either the sense or the antisense strand, or a peptide can be bisconjugated (one peptide tethered to each end, one conjugated to the sense strand, and one conjugated to the antisense strand). In another option, the peptide can be internally conjugated, such as in the loop of a short hairpin iRNA agent. In yet another option, the peptide can be affiliated with a complex, such as a peptide-carrier complex.

A peptide-carrier complex consists of at least a carrier molecule, which can encapsulate one or more iRNA agents (such as for delivery to a biological system and/or a cell), and a peptide moiety tethered to the outside of the carrier molecule, such as for targeting the carrier complex to a particular tissue or cell type. A carrier complex can carry additional targeting molecules on the exterior of the complex, or fusogenic agents to aid in cell delivery. The one or more iRNA agents encapsulated within the carrier can be conjugated to lipophilic molecules, which can aid in the delivery of the agents to the interior of the carrier.

A carrier molecule or structure can be, for example, a micelle, a liposome (e.g., a cationic liposome), a nanoparticle, a microsphere, or a biodegradable polymer. A peptide moiety can be tethered to the carrier molecule by a variety of linkages, such as a disulfide linkage, an acid labile linkage, a peptide-based linkage, an oxyamino linkage or a hydrazine linkage. For example, a peptide-based linkage can be a GFLG peptide. Certain linkages will have particular advantages, and the advantages (or disadvantages) can be considered depending on the tissue target or intended use. For example, peptide based linkages are stable in the blood stream but are susceptible to enzymatic cleavage in the lysosomes.

Targeting

The iRNA agents of the invention are particularly useful when targeted to the liver. An iRNA agent can be targeted to the liver by incorporation of an RRMS containing a ligand that targets the liver. For example, a liver-targeting agent can be a lipophilic moiety. Preferred lipophilic moieties include lipid, cholesterols, oleyl, retinyl, or cholesteryl residues. Other lipophilic moieties that can function as liver-targeting agents include cholic acid, adamantane acetic acid, 1-pyrene butyric acid, dihydrotestosterone, 1,3-Bis-O(hexadecyl) glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

An iRNA agent can also be targeted to the liver by association with a low-density lipoprotein (LDL), such as lactosylated LDL. Polymeric carriers complexed with sugar residues can also function to target iRNA agents to the liver.

A targeting agent that incorporates a sugar, e.g., galactose and/or analogues thereof, is particularly useful. These agents target, in particular, the parenchymal cells of the liver. For example, a targeting moiety can include more than one or preferably two or three galactose moieties, spaced about 15 angstroms from each other. The targeting moiety can alternatively be lactose (e.g., three lactose moieties), which is glucose coupled to a galactose. The targeting moiety can also be N-Acetyl-Galactosamine, N—Ac-Glucosamine. A mannose or mannose-6-phosphate targeting moiety can be used for macrophage targeting.

Conjugation of an iRNA agent with a serum albumin (SA), such as human serum albumin, can also be used to target the iRNA agent to the liver.

An iRNA agent targeted to the liver by an RRMS targeting moiety described herein can target a gene expressed in the liver. For example, the iRNA agent can target p21(WAF1/DIP1), P27(KIP1), the α-fetoprotein gene, beta-catenin, or c-MET, such as for treating a cancer of the liver. In another embodiment, the iRNA agent can target apoB-100, such as for the treatment of an HDL/LDL cholesterol imbalance; dyslipidemias, e.g., familial combined hyperlipidemia (FCHL), or acquired hyperlipidemia; hypercholesterolemia; statin-resistant hypercholesterolemia; coronary artery disease (CAD); coronary heart disease (CHD); or atherosclerosis. In another embodiment, the iRNA agent can target forkhead homologue in rhabdomyosarcoma (FKHR); glucagon; glucagon receptor; glycogen phosphorylase; PPAR-Gamma Coactivator (PGC-1); Fructose-1,6-bisphosphatase; glucose-6-phosphatase; glucose-6-phosphate translocator; glucokinase inhibitory regulatory protein; or phosphoenolpyruvate carboxykinase (PEPCK), such as to inhibit hepatic glucose production in a mammal, such as a human, such as for the treatment of diabetes. In another embodiment, an iRNA agent targeted to the liver can target Factor V, e.g., the Leiden Factor V allele, such as to reduce the tendency to form a blood clot. An iRNA agent targeted to the liver can include a sequence which targets hepatitis virus (e.g., Hepatitis A, B, C, D, E, F, G, or H). For example, an iRNA agent of the invention can target any one of the nonstructural proteins of HCV: NS3, 4A, 4B, 5A, or 5B. For the treatment of hepatitis B, an iRNA agent can target the protein X (HBx) gene, for example.

Preferred ligands on RRMSs include folic acid, glucose, cholesterol, cholic acid, Vitamin E, Vitamin K, or Vitamin A.

Definitions

The term "halo" refers to any radical of fluorine, chlorine, bromine or iodine.

The term "alkyl" refers to a hydrocarbon chain that may be a straight chain or branched chain, containing the indicated number of carbon atoms. For example, $C_1$-$C_{12}$ alkyl indicates that the group may have from 1 to 12 (inclusive) carbon atoms in it. The term "haloalkyl" refers to an alkyl in which one or more hydrogen atoms are replaced by halo, and includes alkyl moieties in which all hydrogens have been replaced by halo (e.g., perfluoroalkyl). Alkyl and haloalkyl groups may be optionally inserted with O, N, or S. The terms "aralkyl" refers to an alkyl moiety in which an alkyl hydrogen atom is replaced by an aryl group. Aralkyl includes groups in which more than one hydrogen atom has been replaced by an aryl group. Examples of "aralkyl" include benzyl, 9-fluorenyl, benzhydryl, and trityl groups.

The term "alkenyl" refers to a straight or branched hydrocarbon chain containing 2-8 carbon atoms and characterized in having one or more double bonds. Examples of a typical alkenyl include, but not limited to, allyl, propenyl, 2-butenyl, 3-hexenyl and 3-octenyl groups. The term "alkynyl" refers to a straight or branched hydrocarbon chain containing 2-8 carbon atoms and characterized in having one or more triple bonds. Some examples of a typical alkynyl are ethynyl, 2-propynyl, and 3-methylbutynyl, and propargyl. The $sp^2$ and $sp^3$ carbons may optionally serve as the point of attachment of the alkenyl and alkynyl groups, respectively.

The term "alkoxy" refers to an —O-alkyl radical. The term "aminoalkyl" refers to an alkyl substituted with an amino The term "mercapto" refers to an —SH radical. The term "thioalkoxy" refers to an —S-alkyl radical.

The term "alkylene" refers to a divalent alkyl (i.e., —R—), e.g., —CH$_2$—, —CH$_2$CH$_2$—, and —CH$_2$CH$_2$CH$_2$—. The term "alkylenedioxo" refers to a divalent species of the structure —O—R—O—, in which R represents an alkylene.

The term "aryl" refers to an aromatic monocyclic, bicyclic, or tricyclic hydrocarbon ring system, wherein any ring atom capable of substitution can be substituted by a substituent. Examples of aryl moieties include, but are not limited to, phenyl, naphthyl, and anthracenyl.

The term "cycloalkyl" as employed herein includes saturated cyclic, bicyclic, tricyclic, or polycyclic hydrocarbon groups having 3 to 12 carbons, wherein any ring atom capable of substitution can be substituted by a substituent. The cycloalkyl groups herein described may also contain fused rings. Fused rings are rings that share a common carbon-carbon bond. Examples of cycloalkyl moieties include, but are not limited to, cyclohexyl, adamantyl, and norbornyl.

The term "heterocyclyl" refers to a nonaromatic 3-10 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein any ring atom capable of substitution can be substituted by a substituent. The heterocyclyl groups herein described may also contain fused rings. Fused rings are rings that share a common carbon-carbon bond. Examples of heterocyclyl include, but are not limited to tetrahydrofuranyl, tetrahydropyranyl, piperidinyl, morpholino, pyrrolinyl and pyrrolidinyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein any ring atom capable of substitution can be substituted by a substituent.

The term "oxo" refers to an oxygen atom, which forms a carbonyl when attached to carbon, an N-oxide when attached to nitrogen, and a sulfoxide or sulfone when attached to sulfur.

The term "acyl" refers to an alkylcarbonyl, cycloalkylcarbonyl, arylcarbonyl, heterocyclylcarbonyl, or heteroarylcarbonyl substituent, any of which may be further substituted by substituents.

The term "substituents" refers to a group "substituted" on an alkyl, cycloalkyl, alkenyl, alkyl, heterocyclyl, heterocycloalkenyl, cycloalkenyl, aryl, or heteroaryl group at any atom of that group. Suitable substituents include, without limitation, alkyl, alkenyl, alkynyl, alkoxy, halo, hydroxy, cyano, nitro, amino, $SO_3H$, sulfate, phosphate, perfluoroalkyl, perfluoroalkoxy, methylenedioxy, ethylenedioxy, carboxyl, oxo, thioxo, imino (alkyl, aryl, aralkyl), $S(O)_n$alkyl (where n is 0-2), $S(O)_n$ aryl (where n is 0-2), $S(O)_n$ heteroaryl (where n is 0-2), $S(O)_n$ heterocyclyl (where n is 0-2), amine (mono-, di-, alkyl, cycloalkyl, aralkyl, heteroaralkyl, and combinations thereof), ester (alkyl, aralkyl, heteroaralkyl), amide (mono-, di-, alkyl, aralkyl, heteroaralkyl, and combinations thereof), sulfonamide (mono-, di-, alkyl, aralkyl, heteroaralkyl, and combinations thereof), unsubstituted aryl, unsubstituted heteroaryl, unsubstituted heterocyclyl, and unsubstituted cycloalkyl. In one aspect, the substituents on a group are independently any one single, or any subset of the aforementioned substituents.

The terms "adeninyl, cytosinyl, guaninyl, thyminyl, and uracilyl" and the like refer to radicals of adenine, cytosine, guanine, thymine, and uracil.

As used herein, an "unusual" nucleobase can include any one of the following:

2-methyladeninyl,
N6-methyladeninyl,
2-methylthio-N6-methyladeninyl,
N6-isopentenyladeninyl,
2-methylthio-N6-isopentenyladeninyl,
N6-(cis-hydroxyisopentenyl)adeninyl,
2-methylthio-N6-(cis-hydroxyisopentenyl) adeninyl,
N6-glycinylcarbamoyladeninyl,
N6-threonylcarbamoyladeninyl,
2-methylthio-N6-threonyl carbamoyladeninyl,
N6-methyl-N6-threonylcarbamoyladeninyl,
N6-hydroxynorvalylcarbamoyladeninyl,
2-methylthio-N6-hydroxynorvalyl carbamoyladeninyl,
N6,N6-dimethyladeninyl,
3-methylcytosinyl,
5-methylcytosinyl,
2-thiocytosinyl,
5-formylcytosinyl,

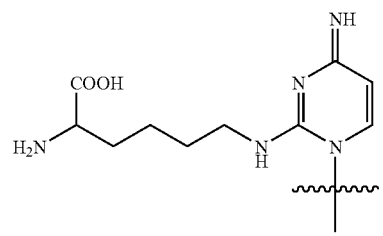

N4-methylcytosinyl,
5-hydroxymethylcytosinyl,
1-methylguaninyl,
N2-methylguaninyl,
7-methylguaninyl,
N2,N2-dimethylguaninyl,

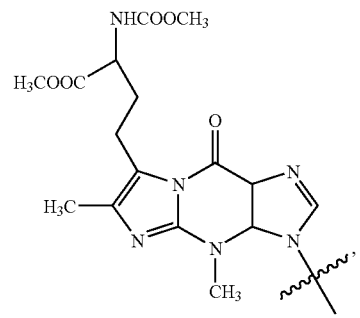

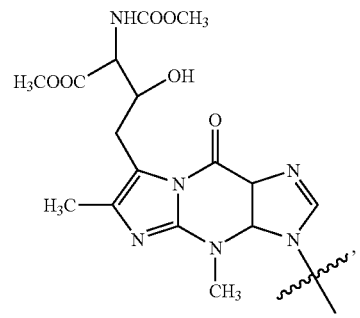

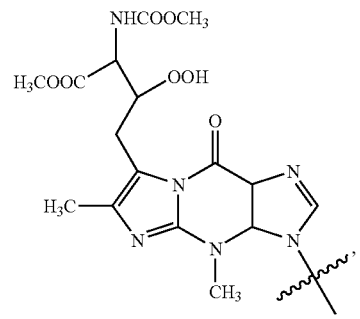

-continued

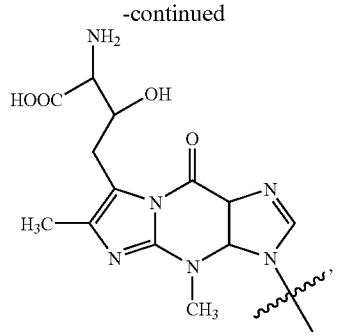

N2,7-dimethylguaninyl,

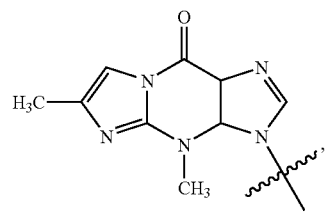

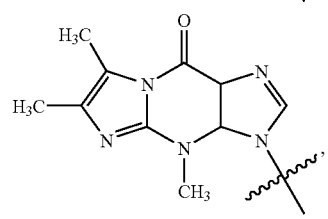

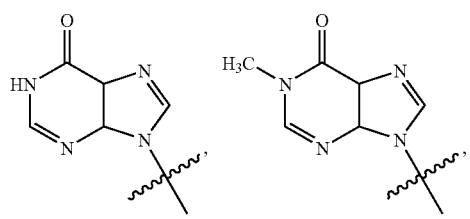

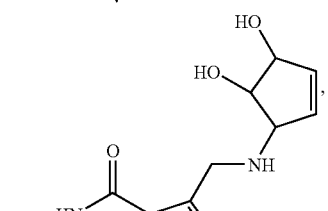

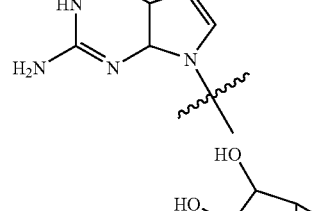

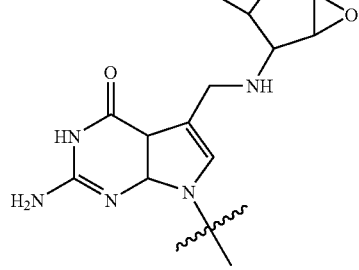

-continued

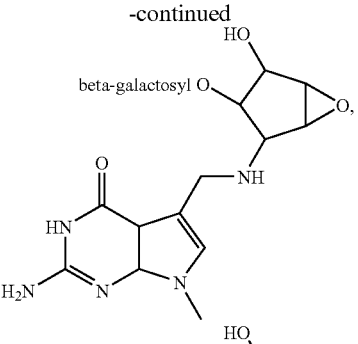

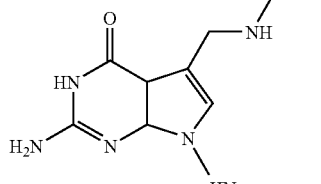

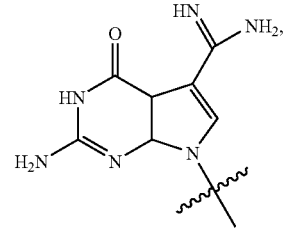

N2,N2,7-trimethylguaninyl,
1-methylguaninyl,
7-cyano-7-deazaguaninyl,
7-aminomethyl-7-deazaguaninyl,
pseudouracilyl,
dihydrouracilyl,
5-methyluracilyl,
1-methylpseudouracilyl,
2-thiouracilyl,
4-thiouracilyl,
2-thiothyminyl
5-methyl-2-thiouracilyl,
3-(3-amino-3-carboxypropyl)uracilyl,
5-hydroxyuracilyl,
5-methoxyuracilyl,
uracilyl 5-oxyacetic acid,
uracilyl 5-oxyacetic acid methyl ester,
5-(carboxyhydroxymethyl)uracilyl,
5-(carboxyhydroxymethyl)uracilyl methyl ester,
5-methoxycarbonylmethyluracilyl,
5-methoxycarbonylmethyl-2-thiouracilyl,
5-aminomethyl-2-thiouracilyl,
5-methylaminomethyluracilyl,
5-methylaminomethyl-2-thiouracilyl,
5-methylaminomethyl-2-selenouracilyl,
5-carbamoylmethyluracilyl,
5-carboxymethylaminomethyluracilyl,
5-carboxymethylaminomethyl-2-thiouracilyl,
3-methyluracilyl,
1-methyl-3-(3-amino-3-carboxypropyl)pseudouracilyl,
5-carboxymethyluracilyl,
5-methyldihydrouracilyl, or
3-methylpseudouracilyl.

Asymmetrical Modifications

In one aspect, the invention features an iRNA agent which can be asymmetrically modified as described herein.

In addition, the invention includes iRNA agents having asymmetrical modifications and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA agent having an architecture or structure described herein, an iRNA associated with an amphipathic delivery agent described herein, an iRNA associated with a drug delivery module described herein, an iRNA agent administered as described herein, or an iRNA agent formulated as described herein, which also incorporates an asymmetrical modification.

iRNA agents of the invention can be asymmetrically modified. An asymmetrically modified iRNA agent is one in which a strand has a modification which is not present on the other strand. An asymmetrical modification is a modification found on one strand but not on the other strand. Any modification, e.g., any modification described herein, can be present as an asymmetrical modification. An asymmetrical modification can confer any of the desired properties associated with a modification, e.g., those properties discussed herein. E.g., an asymmetrical modification can: confer resistance to degradation, an alteration in half life; target the iRNA agent to a particular target, e.g., to a particular tissue; modulate, e.g., increase or decrease, the affinity of a strand for its complement or target sequence; or hinder or promote modification of a terminal moiety, e.g., modification by a kinase or other enzymes involved in the RISC mechanism pathway. The designation of a modification as having one property does not mean that it has no other property, e.g., a modification referred to as one which promotes stabilization might also enhance targeting.

While not wishing to be bound by theory or any particular mechanistic model, it is believed that asymmetrical modification allows an iRNA agent to be optimized in view of the different or "asymmetrical" functions of the sense and antisense strands. For example, both strands can be modified to increase nuclease resistance, however, since some changes can inhibit RISC activity, these changes can be chosen for the sense stand. In addition, since some modifications, e.g., targeting moieties, can add large bulky groups that, e.g., can interfere with the cleavage activity of the RISC complex, such modifications are preferably placed on the sense strand. Thus, targeting moieties, especially bulky ones (e.g. cholesterol), are preferentially added to the sense strand. In one embodiment, an asymmetrical modification in which a phosphate of the backbone is substituted with S, e.g., a phosphorothioate modification, is present in the antisense strand, and a 2' modification, e.g., 2' OMe is present in the sense strand. A targeting moiety can be present at either (or both) the 5' or 3' end of the sense strand of the iRNA agent. In a preferred example, a P of the backbone is replaced with S in the antisense strand, 2'OMe is present in the sense strand, and a targeting moiety is added to either the 5' or 3' end of the sense strand of the iRNA agent.

In a preferred embodiment an asymmetrically modified iRNA agent has a modification on the sense strand which modification is not found on the antisense strand and the antisense strand has a modification which is not found on the sense strand.

Each strand can include one or more asymmetrical modifications. By way of example: one strand can include a first asymmetrical modification which confers a first property on the iRNA agent and the other strand can have a second asymmetrical modification which confers a second property on the iRNA. E.g., one strand, e.g., the sense strand can have a modification which targets the iRNA agent to a tissue, and the other strand, e.g., the antisense strand, has a modification which promotes hybridization with the target gene sequence.

In some embodiments both strands can be modified to optimize the same property, e.g., to increase resistance to nucleolytic degradation, but different modifications are chosen for the sense and the antisense strands, e.g., because the modifications affect other properties as well. E.g., since some changes can affect RISC activity these modifications are chosen for the sense strand.

In an embodiment one strand has an asymmetrical 2' modification, e.g., a 2' OMe modification, and the other strand has an asymmetrical modification of the phosphate backbone, e.g., a phosphorothioate modification. So, in one embodiment the antisense strand has an asymmetrical 2' OMe modification and the sense strand has an asymmetrical phosphorothioate modification (or vice versa). In a particularly preferred embodiment the RNAi agent will have asymmetrical 2'-O alkyl, preferably, 2'-OMe modifications on the sense strand and asymmetrical backbone P modification, preferably a phosphothioate modification in the antisense strand. There can be one or multiple 2'-OMe modifications, e.g., at least 2, 3, 4, 5, or 6, of the subunits of the sense strand can be so modified. There can be one or multiple phosphorothioate modifications, e.g., at least 2, 3, 4, 5, or 6, of the subunits of the antisense strand can be so modified. It is preferable to have an iRNA agent wherein there are multiple 2'-OMe modifications on the sense strand and multiple phosphorothioate modifications on the antisense strand. All of the subunits on one or both strands can be so modified. A particularly preferred embodiment of multiple asymmetric modification on both strands has a duplex region about 20-21, and preferably 19, subunits in length and one or two 3' overhangs of about 2 subunits in length.

Asymmetrical modifications are useful for promoting resistance to degradation by nucleases, e.g., endonucleases. iRNA agents can include one or more asymmetrical modifications which promote resistance to degradation. In preferred embodiments the modification on the antisense strand is one which will not interfere with silencing of the target, e.g., one which will not interfere with cleavage of the target. Most if not all sites on a strand are vulnerable, to some degree, to degradation by endonucleases. One can determine sites which are relatively vulnerable and insert asymmetrical modifications which inhibit degradation. It is often desirable to provide asymmetrical modification of a UA site in an iRNA agent, and in some cases it is desirable to provide the UA sequence on both strands with asymmetrical modification. Examples of modifications which inhibit endonucleolytic degradation can be found herein. Particularly favored modifications include: 2' modification, e.g., provision of a 2' OMe moiety on the U, especially on a sense strand; modification of the backbone, e.g., with the replacement of an O with an S, in the phosphate backbone, e.g., the provision of a phosphorothioate modification, on the U or the A or both, especially on an antisense strand; replacement of the U with a C5 amino linker; replacement of the A with a G (sequence changes are preferred to be located on the sense strand and not the antisense strand); and modification of the at the 2', 6', 7', or 8' position. Preferred embodiments are those in which one or more of these modifications are present on the sense but not the antisense strand, or embodiments where the antisense strand has fewer of such modifications.

Asymmetrical modification can be used to inhibit degradation by exonucleases. Asymmetrical modifications can include those in which only one strand is modified as well as those in which both are modified. In preferred embodiments the modification on the antisense strand is one which will not interfere with silencing of the target, e.g., one which will not interfere with cleavage of the target. Some embodiments will have an asymmetrical modification on the sense strand, e.g., in a 3' overhang, e.g., at the 3' terminus, and on the antisense strand, e.g., in a 3' overhang, e.g., at the 3' terminus. If the modifications introduce moieties of different size it is preferable that the larger be on the sense strand. If the modifications introduce moieties of different charge it is preferable that the one with greater charge be on the sense strand.

Examples of modifications which inhibit exonucleolytic degradation can be found herein. Particularly favored modifications include: 2' modification, e.g., provision of a 2' OMe moiety in a 3' overhang, e.g., at the 3' terminus (3' terminus means at the 3' atom of the molecule or at the most 3' moiety, e.g., the most 3' P or 2' position, as indicated by the context); modification of the backbone, e.g., with the replacement of a P with an S, e.g., the provision of a phosphorothioate modification, or the use of a methylated P in a 3' overhang, e.g., at the 3' terminus; combination of a 2' modification, e.g., provision of a 2' O Me moiety and modification of the backbone, e.g., with the replacement of a P with an S, e.g., the provision of a phosphorothioate modification, or the use of a methylated P, in a 3' overhang, e.g., at the 3' terminus; modification with a 3' alkyl; modification with an abasic pyrrolidine in a 3' overhang, e.g., at the 3' terminus; modification with naproxene, ibuprofen, or other moieties which inhibit degradation at the 3' terminus. Preferred embodiments are those in which one or more of these modifications are present on the sense but not the antisense strand, or embodiments where the antisense strand has fewer of such modifications.

Modifications, e.g., those described herein, which affect targeting can be provided as asymmetrical modifications. Targeting modifications which can inhibit silencing, e.g., by inhibiting cleavage of a target, can be provided as asymmetrical modifications of the sense strand. A biodistribution altering moiety, e.g., cholesterol, can be provided in one or more, e.g., two, asymmetrical modifications of the sense strand. Targeting modifications which introduce moieties having a relatively large molecular weight, e.g., a molecular weight of more than 400, 500, or 1000 daltons, or which introduce a charged moiety (e.g., having more than one positive charge or one negative charge) can be placed on the sense strand.

Modifications, e.g., those described herein, which modulate, e.g., increase or decrease, the affinity of a strand for its compliment or target, can be provided as asymmetrical modifications. These include: 5 methyl U; 5 methyl C; pseudouridine, Locked nucleic acids, 2 thio U and 2-amino-A. In some embodiments one or more of these is provided on the antisense strand.

iRNA agents have a defined structure, with a sense strand and an antisense strand, and in many cases short single strand overhangs, e.g., of 2 or 3 nucleotides are present at one or both 3' ends. Asymmetrical modification can be used to optimize the activity of such a structure, e.g., by being placed selectively within the iRNA. E.g., the end region of the iRNA agent defined by the 5' end of the sense strand and the 3' end of the antisense strand is important for function. This region can include the terminal 2, 3, or 4 paired nucleotides and any 3' overhang. In preferred embodiments asymmetrical modifications which result in one or more of the following are used: modifications of the 5' end of the sense strand which inhibit kinase activation of the sense strand, including, e.g., attachments of conjugates which target the molecule or the use modifications which protect against 5' exonucleolytic degradation; or modifications of either strand, but preferably the sense strand, which enhance binding between the sense and antisense strand and thereby promote a "tight" structure at this end of the molecule.

The end region of the iRNA agent defined by the 3' end of the sense strand and the 5' end of the antisense strand is also important for function. This region can include the terminal 2, 3, or 4 paired nucleotides and any 3' overhang. Preferred embodiments include asymmetrical modifications of either strand, but preferably the sense strand, which decrease binding between the sense and antisense strand and thereby promote an "open" structure at this end of the molecule. Such modifications include placing conjugates which target the molecule or modifications which promote nuclease resistance on the sense strand in this region. Modification of the antisense strand which inhibit kinase activation are avoided in preferred embodiments.

Exemplary modifications for asymmetrical placement in the sense strand include the following:

(a) backbone modifications, e.g., modification of a backbone P, including replacement of P with S, or P substituted with alkyl or allyl, e.g., Me, and dithioates (S—P=S); these modifications can be used to promote nuclease resistance;

(b) 2'-O alkyl, e.g., 2'-OMe, 3'-O alkyl, e.g., 3'-OMe (at terminal and/or internal positions); these modifications can be used to promote nuclease resistance or to enhance binding of the sense to the antisense strand, the 3' modifications can be used at the 5' end of the sense strand to avoid sense strand activation by RISC;

(c) 2'-5' linkages (with 2'-H, 2'-OH and 2'-OMe and with P=O or P=S) these modifications can be used to promote nuclease resistance or to inhibit binding of the sense to the antisense strand, or can be used at the 5' end of the sense strand to avoid sense strand activation by RISC;

(d) L sugars (e.g., L ribose, L-arabinose with 2'-H, 2'-OH and 2'-OMe); these modifications can be used to promote nuclease resistance or to inhibit binding of the sense to the antisense strand, or can be used at the 5' end of the sense strand to avoid sense strand activation by RISC;

(e) modified sugars (e.g., locked nucleic acids (LNA's), hexose nucleic acids (HNA's) and cyclohexene nucleic acids (CeNA's)); these modifications can be used to promote nuclease resistance or to inhibit binding of the sense to the antisense strand, or can be used at the 5' end of the sense strand to avoid sense strand activation by RISC;

(f) nucleobase modifications (e.g., C-5 modified pyrimidines, N-2 modified purines, N-7 modified purines, N-6 modified purines), these modifications can be used to promote nuclease resistance or to enhance binding of the sense to the antisense strand;

(g) cationic groups and Zwitterionic groups (preferably at a terminus), these modifications can be used to promote nuclease resistance;

(h) conjugate groups (preferably at terminal positions), e.g., naproxen, biotin, cholesterol, ibuprofen, folic acid, peptides, and carbohydrates; these modifications can be used to promote nuclease resistance or to target the molecule, or can be used at the 5' end of the sense strand to avoid sense strand activation by RISC.

Exemplary modifications for asymmetrical placement in the antisense strand include the following:

(a) backbone modifications, e.g., modification of a backbone P, including replacement of P with S, or P substituted with alkyl or allyl, e.g., Me, and dithioates (S—P=S);

(b) 2'-O alkyl, e.g., 2'-OMe, (at terminal positions);

(c) 2'-5' linkages (with 2'-H, 2'-OH and 2'-OMe) e.g., terminal at the 3' end); e.g., with P=O or P=S preferably at the 3'-end, these modifications are preferably excluded from the 5' end region as they may interfere with RISC enzyme activity such as kinase activity;

(d) L sugars (e.g, L ribose, L-arabinose with 2'-H, 2'-OH and 2'-OMe); e.g., terminal at the 3' end; e.g., with P=O or P=S preferably at the 3'-end, these modifications are preferably excluded from the 5' end region as they may interfere with kinase activity;

(e) modified sugars (e.g., LNA's, HNA's and CeNA's); these modifications are preferably excluded from the 5' end region as they may contribute to unwanted enhancements of paring between the sense and antisense strands, it is often preferred to have a "loose" structure in the 5' region, additionally, they may interfere with kinase activity;

(f) nucleobase modifications (e.g., C-5 modified pyrimidines, N-2 modified purines, N-7 modified purines, N-6 modified purines);

(g) cationic groups and Zwitterionic groups (preferably at a terminus);

conjugate groups (preferably at terminal positions), e.g., naproxen, biotin, cholesterol, ibuprofen, folic acid, peptides, and carbohydrates, but bulky groups or generally groups which inhibit RISC activity should are less preferred.

The 5'-OH of the antisense strand should be kept free to promote activity. In some preferred embodiments modifications that promote nuclease resistance should be included at the 3' end, particularly in the 3' overhang.

In another aspect, the invention features a method of optimizing, e.g., stabilizing, an iRNA agent. The method includes selecting a sequence having activity, introducing one or more asymmetric modifications into the sequence, wherein the introduction of the asymmetric modification optimizes a property of the iRNA agent but does not result in a decrease in activity.

The decrease in activity can be less than a preselected level of decrease. In preferred embodiments decrease in activity means a decrease of less than 5, 10, 20, 40, or 50% activity, as compared with an otherwise similar iRNA lacking the introduced modification. Activity can, e.g., be measured in vivo, or in vitro, with a result in either being sufficient to demonstrate the required maintenance of activity.

The optimized property can be any property described herein and in particular the properties discussed in the section on asymmetrical modifications provided herein. The modification can be any asymmetrical modification, e.g., an asymmetric modification described in the section on asymmetrical modifications described herein. Particularly preferred asymmetric modifications are 2'-O alkyl modifications, e.g., 2'-OMe modifications, particularly in the sense sequence, and modifications of a backbone O, particularly phosphorothioate modifications, in the antisense sequence.

In a preferred embodiment a sense sequence is selected and provided with an asymmetrical modification, while in other embodiments an antisense sequence is selected and provided with an asymmetrical modification. In some embodiments both sense and antisense sequences are selected and each provided with one or more asymmetrical modifications.

Multiple asymmetric modifications can be introduced into either or both of the sense and antisense sequence. A sequence can have at least 2, 4, 6, 8, or more modifications and all or substantially all of the monomers of a sequence can be modified.

Table: 2. Some examples of Asymmetric Modification

This table shows examples having strand I with a selected modification and strand II with a selected modification.

| Strand I | Strand II |
| --- | --- |
| Nuclease Resistance (e.g. 2'-OMe) | Biodistribution (e.g., P=S) |
| Biodistribution conjugate (e.g. Lipophile) | Protein Binding Functionality (e.g. Naproxen) |
| Tissue Distribution Functionality (e.g. Carbohydrates) | Cell Targeting Functionality (e.g. Folate for cancer cells) |
| Tissue Distribution Functionality (e.g. Liver Cell Targeting Carbohydrates) | Fusogenic Functionality (e.g. Polyethylene imines) |
| Cancer Cell Targeting (e.g. RGD peptides and imines) | Fusogenic Functionality (e.g. peptides) |
| Nuclease Resistance (e.g. 2'-OMe) | Increase in binding Affinity (5-Me-C, 5-Me-U, 2-thio-U, 2-amino-A, G-clamp, LNA) |
| Tissue Distribution Functionality | RISC activity improving Functionality |
| Helical conformation changing Functionalities | Tissue Distribution Functionality (P=S; lipophile, carbohydrates) |

Z-X-Y Architecture

In one aspect, the invention features an iRNA agent which can have a Z-X-Y architecture or structure such as those described herein and those described in copending, co-owned U.S. Provisional Application Ser. No. 60/510,246, filed on Oct. 9, 2003, which is hereby incorporated by reference, and in copending, co-owned U.S. Provisional Application Ser. No. 60/510,318, filed on Oct. 10, 2003, which is hereby incorporated by reference.

In addition, the invention includes iRNA agents having a Z-X-Y structure and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA associated with an amphipathic delivery agent described herein, an iRNA associated with a drug delivery module described herein, an iRNA agent administered as described herein, or an iRNA agent formulated as described herein, which also incorporates a Z-X-Y architecture.

The invention provides an iRNA agent having a first segment, the Z region, a second segment, the X region, and optionally a third region, the Y region:

Z—X—Y.

It may be desirable to modify subunits in one or both of Z and/or Y on one hand and X on the other hand. In some cases they will have the same modification or the same class of modification but it will more often be the case that the modifications made in Z and/or Y will differ from those made in X.

The Z region typically includes a terminus of an iRNA agent. The length of the Z region can vary, but will typically be from 2-14, more preferably 2-10, subunits in length. It typically is single stranded, i.e., it will not base pair with bases of another strand, though it may in some embodiments self associate, e.g., to form a loop structure. Such structures can be formed by the end of a strand looping back and forming an intrastrand duplex. E.g., 2, 3, 4, 5 or more intra-strand bases pairs can form, having a looped out or connecting region, typically of 2 or more subunits which do not pair. This can occur at one or both ends of a strand. A typical embodiment of a Z region is a single strand overhang, e.g., an over hang of the length described elsewhere herein. The Z region can thus be or include a 3' or 5' terminal single strand. It can be sense or antisense strand but if it is antisense it is preferred that it is a 3-overhang. Typical inter-subunit bonds in the Z region include: P=O; P=S; S—P=S; P—NR$_2$; and P—BR$_2$. Chiral P=X, where X is S, N, or B) inter-subunit bonds can also be present. (These inter-subunit bonds are discussed in more detail elsewhere herein.) Other preferred Z region subunit modifications (also discussed elsewhere herein) can include: 3'-OR, 3'SR, 2'-OMe, 3'-OMe, and 2'OH modifications and moieties; alpha configuration bases; and 2' arabino modifications.

The X region will in most cases be duplexed, in the case of a single strand iRNA agent, with a corresponding region of the single strand, or in the case of a double stranded iRNA agent, with the corresponding region of the other strand. The length of the X region can vary but will typically be between 10-45 and more preferably between 15 and 35 subunits. Particularly preferred region X's will include 17, 18, 19, 29, 21, 22, 23, 24, or 25 nucleotide pairs, though other suitable lengths are described elsewhere herein and can be used. Typical X region subunits include 2'-OH subunits. In typical embodiments phosphate inter-subunit bonds are preferred while phosphorothioate or non-phosphate bonds are absent. Other modifications preferred in the X region include: modifications to improve binding, e.g., nucleobase modifications; cationic nucleobase modifications; and C-5 modified pyrimidines, e.g., allylamines. Some embodiments have 4 or more consecutive 2'OH subunits. While the use of phosphorothioate is sometimes non preferred they can be used if they connect less than 4 consecutive 2'OH subunits.

The Y region will generally conform to the parameters set out for the Z regions. However, the X and Z regions need not be the same, different types and numbers of modifications can be present, and infact, one will usually be a 3' overhang and one will usually be a 5' overhang.

In a preferred embodiment the iRNA agent will have a Y and/or Z region each having ribonucleosides in which the 2'-OH is substituted, e.g., with 2'-OMe or other alkyl; and an X region that includes at least four consecutive ribonucleoside subunits in which the 2'-OH remains unsubstituted.

The subunit linkages (the linkages between subunits) of an iRNA agent can be modified, e.g., to promote resistance to degradation. Numerous examples of such modifications are disclosed herein, one example of which is the phosphorothioate linkage. These modifications can be provided between the subunits of any of the regions, Y, X, and Z. However, it is preferred that their occureceis minimized and in particular it is preferred that consecutive modified linkages be avoided.

In a preferred embodiment the iRNA agent will have a Y and Z region each having ribonucleosides in which the 2'-OH is substituted, e.g., with 2'-OMe; and an X region that includes at least four consecutive subunits, e.g., ribonucleoside subunits in which the 2'-OH remains unsubstituted.

As mentioned above, the subunit linkages of an iRNA agent can be modified, e.g., to promote resistance to degradation. These modifications can be provided between the subunits of any of the regions, Y, X, and Z. However, it is preferred that they are minimized and in particular it is preferred that consecutive modified linkages be avoided.

Thus, in a preferred embodiment, not all of the subunit linkages of the iRNA agent are modified and more preferably the maximum number of consecutive subunits linked by other than a phosphodiester bond will be 2, 3, or 4. Particularly preferred iRNA agents will not have four or more consecutive subunits, e.g., 2'-hydroxyl ribonucleoside subunits, in which each subunits is joined by modified linkages—i.e. linkages that have been modified to stabilize them from degradation as compared to the phosphodiester linkages that naturally occur in RNA and DNA.

It is particularly preferred to minimize the occurrence in region X. Thus, in preferred embodiments each of the nucleoside subunit linkages in X will be phosphodiester linkages, or if subunit linkages in region X are modified, such modifications will be minimized. E.g., although the Y and/or Z regions can include inter subunit linkages which have been stabilized against degradation, such modifications will be minimized in the X region, and in particular consecutive modifications will be minimized. Thus, in preferred embodiments the maximum number of consecutive subunits linked by other than a phosphodiester bond will be 2, 3, or 4. Particularly preferred X regions will not have four or more consecutive subunits, e.g., 2'-hydroxyl ribonucleoside subunits, in which each subunits is joined by modified linkages—i.e. linkages that have been modified to stabilize them from degradation as compared to the phosphodiester linkages that naturally occur in RNA and DNA.

In a preferred embodiment Y and/or Z will be free of phosphorothioate linkages, though either or both may contain other modifications, e.g., other modifications of the subunit linkages.

In a preferred embodiment region X, or in some cases, the entire iRNA agent, has no more than 3 or no more than 4 subunits having identical 2' moieties.

In a preferred embodiment region X, or in some cases, the entire iRNA agent, has no more than 3 or no more than 4 subunits having identical subunit linkages.

In a preferred embodiment one or more phosphorothioate linkages (or other modifications of the subunit linkage) are present in Y and/or Z, but such modified linkages do not connect two adjacent subunits, e.g., nucleosides, having a 2' modification, e.g., a 2'-O-alkyl moiety. E.g., any adjacent 2'-O-alkyl moieties in the Y and/or Z, are connected by a linkage other than a a phosphorothioate linkage.

In a preferred embodiment each of Y and/or Z independently has only one phosphorothioate linkage between adjacent subunits, e.g., nucleosides, having a 2' modification, e.g., 2'-O-alkyl nucleosides. If there is a second set of adjacent subunits, e.g., nucleosides, having a 2' modification, e.g., 2'-O-alkyl nucleosides, in Y and/or Z that second set is connected by a linkage other than a phosphorothioate linkage, e.g., a modified linkage other than a phosphorothioate linkage.

In a preferred embodiment each of Y and/or Z independently has more than one phosphorothioate linkage connecting adjacent pairs of subunits, e.g., nucleosides, having a 2' modification, e.g., 2'-O-alkyl nucleosides, but at least one pair of adjacent subunits, e.g., nucleosides, having a 2' modification; e.g., 2'-O-alkyl nucleosides, are be connected by a linkage other than a phosphorothioate linkage, e.g., a modified linkage other than a phosphorothioate linkage.

In a preferred embodiment one of the above recited limitation on adjacent subunits in Y and or Z is combined with a limitation on the subunits in X. E.g., one or more phosphorothioate linkages (or other modifications of the subunit linkage) are present in Y and/or Z, but such modified linkages do not connect two adjacent subunits, e.g., nucleosides, having a 2' modification, e.g., a 2'-O-alkyl moiety. E.g., any adjacent 2'-O-alkyl moieties in the Y and/or Z, are connected by a linkage other than a a phosphorothioate linkage. In addition, the X region has no more than 3 or no more than 4 identical subunits, e.g., subunits having identical 2' moieties or the X region has no more than 3 or no more than 4 subunits having identical subunit linkages.

A Y and/or Z region can include at least one, and preferably 2, 3 or 4 of a modification disclosed herein. Such modifications can be chosen, independently, from any modification described herein, e.g., from nuclease resistant subunits, subunits with modified bases, subunits with modified intersubunit linkages, subunits with modified sugars, and subunits linked to another moiety, e.g., a targeting moiety. In a preferred embodiment more than 1 of such subunits can be present but in some embodiments it is preferred that no more than 1, 2, 3, or 4 of such modifications occur, or occur consecutively. In a preferred embodiment the frequency of the modification will differ between Y and/or Z and X, e.g., the modification will be present one of Y and/or Z or X and absent in the other.

An X region can include at least one, and preferably 2, 3 or 4 of a modification disclosed herein. Such modifications can be chosen, independently, from any modification described herein, e.g., from nuclease resistant subunits, subunits with modified bases, subunits with modified intersubunit linkages, subunits with modified sugars, and subunits linked to another moiety, e.g., a targeting moiety. In a preferred embodiment more than 1 of such subunits can b present but in some embodiments it is preferred that no more than 1, 2, 3, or 4 of such modifications occur, or occur consecutively.

An RRMS (described elsewhere herein) can be introduced at one or more points in one or both strands of a double-stranded iRNA agent. An RRMS can be placed in a Y and/or Z region, at or near (within 1, 2, or 3 positions) of the 3' or 5' end of the sense strand or at near (within 2 or 3 positions of) the 3' end of the antisense strand. In some embodiments it is preferred to not have an RRMS at or near (within 1, 2, or 3 positions of) the 5' end of the antisense strand. An RRMS can be positioned in the X region, and will preferably be positioned in the sense strand or in an area of the antisense strand not critical for antisense binding to the target.

Differential Modification of Terminal Duplex Stability

In one aspect, the invention features an iRNA agent which can have differential modification of terminal duplex stability (DMTDS).

In addition, the invention includes iRNA agents having DMTDS and another element described herein. E.g., the invention includes an iRNA agent described herein, e.g., a palindromic iRNA agent, an iRNA agent having a non canonical pairing, an iRNA agent which targets a gene described herein, e.g., a gene active in the liver, an iRNA agent having an architecture or structure described herein, an iRNA associated with an amphipathic delivery agent described herein, an iRNA associated with a drug delivery module described herein, an iRNA agent administered as described herein, or an iRNA agent formulated as described herein, which also incorporates DMTDS.

iRNA agents can be optimized by increasing the propensity of the duplex to disassociate or melt (decreasing the free energy of duplex association), in the region of the 5' end of the antisense strand duplex. This can be accomplished, e.g., by the inclusion of subunits which increase the propensity of the duplex to disassociate or melt in the region of the 5' end of the antisense strand. It can also be accomplished by the attachment of a ligand that increases the propensity of the duplex to disassociate of melt in the region of the 5' end. While not wishing to be bound by theory, the effect may be due to promoting the effect of an enzyme such as helicase, for example, promoting the effect of the enzyme in the proximity of the 5' end of the antisense strand.

The inventors have also discovered that iRNA agents can be optimized by decreasing the propensity of the duplex to disassociate or melt (increasing the free energy of duplex association), in the region of the 3' end of the antisense strand duplex. This can be accomplished, e.g., by the inclusion of subunits which decrease the propensity of the duplex to disassociate or melt in the region of the 3' end of the antisense strand. It can also be accomplished by the attachment of ligand that decreases the propensity of the duplex to disassociate of melt in the region of the 5' end.

Modifications which increase the tendency of the 5' end of the duplex to dissociate can be used alone or in combination with other modifications described herein, e.g., with modifications which decrease the tendency of the 3' end of the duplex to dissociate. Likewise, modifications which decrease the tendency of the 3' end of the duplex to dissociate can be used alone or in combination with other modifications described herein, e.g., with modifications which increase the tendency of the 5' end of the duplex to dissociate.

Decreasing the Stability of the AS 5' End of the Duplex

Subunit pairs can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation:

A:U is preferred over G:C;

G:U is preferred over G:C;

I:C is preferred over G:C (I=inosine);

mismatches, e.g., non-canonical or other than canonical pairings (as described elsewhere herein) are preferred over canonical (A:T, A:U, G:C) pairings;

pairings which include a universal base are preferred over canonical pairings.

A typical ds iRNA agent can be diagrammed as follows:

S 5' $R_1 N_1 N_2 N_3 N_4 N_5$ [N] $N_{-5} N_{-4} N_{-3} N_{-2} N_{-1} R_2$ 3'

AS 3' $R_3 N_1 N_2 N_3 N_4 N_5$ [N] $N_{-5} N_{-4} N_{-3} N_{-2} N_{-1} R_4$ 5'

S:AS $P_1 P_2 P_3 P_4 P_5$ [N] $P_{-5} P_{-4} P_{-3} P_{-2} P_{-1}$ 5'

S indicates the sense strand; AS indicates antisense strand; $R_1$ indicates an optional (and nonpreferred) 5' sense strand overhang; $R_2$ indicates an optional (though preferred) 3' sense overhang; $R_3$ indicates an optional (though preferred) 3' antisense sense overhang; $R_4$ indicates an optional (and nonpreferred) 5' antisense overhang; N indicates subunits; [N] indicates that additional subunit pairs may be present; and $P_X$, indicates a paring of sense $N_X$ and antisense $N_X$. Overhangs are not shown in the P diagram. In some embodiments a 3' AS overhang corresponds to region Z, the duplex region corresponds to region X, and the 3' S strand overhang corresponds to region Y, as described elsewhere herein. (The diagram is not meant to imply maximum or minimum lengths, on which guidance is provided elsewhere herein.)

It is preferred that pairings which decrease the propensity to form a duplex are used at 1 or more of the positions in the duplex at the 5' end of the AS strand. The terminal pair (the most 5' pair in terms of the AS strand) is designated as $P_{-1}$, and the subsequent pairing positions (going in the 3' direction in terms of the AS strand) in the duplex are designated, $P_{-2}$, $P_{-3}$, $P_{-4}$, $P_{-5}$, and so on. The preferred region in which to modify to modulate duplex formation is at $P_{-5}$ through $P_{-1}$, more preferably $P_{-4}$ through $P_{-1}$, more preferably $P_{-3}$ through $P_{-1}$. Modification at $P_{-1}$, is particularly preferred, alone or with modification(s) other position(s), e.g., any of the positions just identified. It is preferred that at least 1, and more preferably 2, 3, 4, or 5 of the pairs of one of the recited regions be chosen independently from the group of:

A:U

G:U

I:C mismatched pairs, e.g., non-canonical or other than canonical pairings or pairings which include a universal base.

In preferred embodiments the change in subunit needed to achieve a pairing which promotes dissociation will be made in the sense strand, though in some embodiments the change will be made in the antisense strand.

In a preferred embodiment the at least 2, or 3, of the pairs in $P_{-1}$, through $P_{-4}$, are pairs which promote dissociation.

In a preferred embodiment the at least 2, or 3, of the pairs in $P_{-1}$, through $P_{-4}$, are A:U.

In a preferred embodiment the at least 2, or 3, of the pairs in $P_{-1}$, through $P_{-4}$, are G:U.

In a preferred embodiment the at least 2, or 3, of the pairs in $P_{-1}$, through $P_{-4}$, are I:C.

In a preferred embodiment the at least 2, or 3, of the pairs in $P_{-1}$, through $P_{-4}$, are mismatched pairs, e.g., non-canonical or other than canonical pairings pairings.

In a preferred embodiment the at least 2, or 3, of the pairs in $P_{-1}$, through $P_{-4}$, are pairings which include a universal base.

Increasing the Stability of the AS 3' End of the Duplex

Subunit pairs can be ranked on the basis of their propensity to promote stability and inhibit dissociation or melting (e.g., on the free energy of association or dissociation of a particular pairing, the simplest approach is to examine the pairs on an individual pair basis, though next neighbor or similar analysis can also be used). In terms of promoting duplex stability:

G:C is preferred over A:U

Watson-Crick matches (A:T, A:U, G:C) are preferred over non-canonical or other than canonical pairings analogs that increase stability are preferred over Watson-Crick matches (A:T, A:U, G:C)

2-amino-A:U is preferred over A:U 2-thio U or 5 Me-thio-U:A are preferred over U:A G-clamp (an analog of C having 4 hydrogen bonds):G is preferred over C:G guanadinium-G-clamp:G is preferred over C:G psuedo uridine:A is preferred over U:A sugar modifications, e.g., 2' modifications, e.g., 2° F., ENA, or LNA, which enhance binding are preferred over non-modified moieties and can be present on one or both strands to enhance stability of the duplex. It is preferred that pairings which increase the propensity to form a duplex are used at 1 or more of the positions in the duplex at the 3' end of the AS strand. The terminal pair (the most 3' pair in terms of the AS strand) is designated as $P_1$, and the subsequent pairing positions (going in the 5' direction in terms of the AS strand) in the duplex are designated, $P_2$, $P_3$, $P_4$, $P_5$, and so on. The preferred region in which to modify to modulate duplex formation is at $P_5$ through $P_1$, more preferably $P_4$ through $P_1$, more preferably $P_3$ through $P_1$. Modification at $P_1$, is particularly preferred, alone or with modification(s) at other position(s), e.g., any of the positions just identified. It is preferred that at least 1, and more preferably 2, 3, 4, or 5 of the pairs of the recited regions be chosen independently from the group of:

G:C a pair having an analog that increases stability over Watson-Crick matches (A:T, A:U, G:C)

2-amino-A:U 2-thio U or 5 Me-thio-U:A

G-clamp (an analog of C having 4 hydrogen bonds):G guanadinium-G-clamp:G psuedo uridine:A a pair in which one or both subunits has a sugar modification, e.g., a 2' modification, e.g., 2° F., ENA, or LNA, which enhance binding.

In a preferred embodiment the at least 2, or 3, of the pairs in $P_{-1}$, through $P_{-4}$, are pairs which promote duplex stability.

In a preferred embodiment the at least 2, or 3, of the pairs in $P_1$, through $P_4$, are G:C.

In a preferred embodiment the at least 2, or 3, of the pairs in $P_1$, through $P_4$, are a pair having an analog that increases stability over Watson-Crick matches.

In a preferred embodiment the at least 2, or 3, of the pairs in $P_1$, through $P_4$, are 2-amino-A:U.

In a preferred embodiment the at least 2, or 3, of the pairs in $P_1$, through $P_4$, are 2-thio U or 5 Me-thio-U:A.

In a preferred embodiment the at least 2, or 3, of the pairs in $P_1$, through $P_4$, are G-clamp:G.

In a preferred embodiment the at least 2, or 3, of the pairs in $P_1$, through $P_4$, are guanidinium-G-clamp:G.

In a preferred embodiment the at least 2, or 3, of the pairs in $P_1$, through $P_4$, are psuedo uridine:A.

In a preferred embodiment the at least 2, or 3, of the pairs in $P_1$, through $P_4$, are a pair in which one or both subunits has a sugar modification, e.g., a 2' modification, e.g., 2° F., ENA, or LNA, which enhances binding.

G-clamps and guanidinium G-clamps are discussed in the following references: Holmes and Gait, "The Synthesis of 2'-O-Methyl G-Clamp Containing Oligonucleotides and Their Inhibition of the HIV-1 Tat-TAR Interaction," Nucleosides, Nucleotides & Nucleic Acids, 22:1259-1262, 2003; Holmes et al., "Steric inhibition of human immunodeficiency virus type-1 Tat-dependent trans-activation in vitro and in cells by oligonucleotides containing 2'-O-methyl G-clamp ribonucleoside analogues," Nucleic Acids Research, 31:2759-2768, 2003; Wilds, et al., "Structural basis for recognition of guanosine by a synthetic tricyclic cytosine analogue: Guanidinium G-clamp," Helvetica Chimica Acta, 86:966-978, 2003; Rajeev, et al., "High-Affinity Peptide Nucleic Acid Oligomers Containing Tricyclic Cytosine Analogues," Organic Letters, 4:4395-4398, 2002; Ausin, et al., "Synthesis of Amino- and Guanidino-G-Clamp PNA Monomers," Organic Letters, 4:4073-4075, 2002; Maier et al., "Nuclease resistance of oligonucleotides containing the tricyclic cytosine analogues phenoxazine and 9-(2-aminoethoxy)-phenoxazine ("G-clamp") and origins of their nuclease resistance properties," Biochemistry, 41:1323-7, 2002; Flanagan, et al., "A cytosine analog that confers enhanced potency to antisense oligonucleotides," Proceedings Of The National Academy Of Sciences Of The United States Of America, 96:3513-8, 1999.

Simultaneously Decreasing the Stability of the AS 5' End of the Duplex and Increasing the Stability of the AS 3' End of the Duplex As is discussed above, an iRNA agent can be modified to both decrease the stability of the AS 5' end of the duplex and increase the stability of the AS 3' end of the duplex. This can be effected by combining one or more of the stability decreasing modifications in the AS 5' end of the duplex with one or more of the stability increasing modifications in the AS 3' end of the duplex. Accordingly a preferred embodiment includes modification in $P_{-5}$ through $P_{-1}$, more preferably $P_{-4}$ through $P_{-1}$ and more preferably $P_{-3}$ through $P_{-1}$. Modification at $P_{-1}$, is particularly preferred, alone or with other position, e.g., the positions just identified. It is preferred that at least 1, and more preferably 2, 3, 4, or 5 of the pairs of one of the recited regions of the AS 5' end of the duplex region be chosen independently from the group of:

A:U
G:U
I:C mismatched pairs, e.g., non-canonical or other than canonical pairings which include a universal base; and a modification in $P_5$ through $P_1$, more preferably $P_4$ through $P_1$ and more preferably $P_3$ through $P_1$. Modification at $P_1$, is particularly preferred, alone or with other position, e.g., the positions just identified. It is preferred that at least 1, and more preferably 2, 3, 4, or 5 of the pairs of one of the recited regions of the AS 3' end of the duplex region be chosen independently from the group of:

G:C
a pair having an analog that increases stability over Watson-Crick matches (A:T, A:U, G:C)
2-amino-A:U
2-thio U or 5 Me-thio-U:A
G-clamp (an analog of C having 4 hydrogen bonds):G
guanadinium-G-clamp:G
psuedo uridine:A
a pair in which one or both subunits has a sugar modification, e.g., a 2' modification, e.g., 2° F., ENA, or LNA, which enhance binding.

The invention also includes methods of selecting and making iRNA agents having DMTDS. E.g., when screening a target sequence for candidate sequences for use as iRNA agents one can select sequences having a DMTDS property described herein or one which can be modified, preferably with as few changes as possible, especially to the AS strand, to provide a desired level of DMTDS.

The invention also includes, providing a candidate iRNA agent sequence, and modifying at least one P in $P_{-5}$ through $P_{-1}$ and/or at least one P in $P_5$ through $P_1$ to provide a DMTDS iRNA agent.

DMTDS iRNA agents can be used in any method described herein, e.g., to silence any gene disclosed herein, to treat any disorder described herein, in any formulation described herein, and generally in and/or with the methods and compositions described elsewhere herein. DMTDS iRNA agents can incorporate other modifications described herein, e.g., the attachment of targeting agents or the inclusion of modifications which enhance stability, e.g., the inclusion of nuclease resistant monomers or the inclusion of single strand overhangs (e.g., 3' AS overhangs and/or 3' S strand overhangs) which self associate to form intrastrand duplex structure.

Preferably these iRNA agents will have an architecture described herein.

Other Embodiments

In Vivo Delivery

An iRNA agent can be linked, e.g., noncovalently linked to a polymer for the efficient delivery of the iRNA agent to a subject, e.g., a mammal, such as a human. The iRNA agent can, for example, be complexed with cyclodextrin. Cyclodextrins have been used as delivery vehicles of therapeutic compounds. Cyclodextrins can form inclusion complexes with drugs that are able to fit into the hydrophobic cavity of the cyclodextrin. In other examples, cyclodextrins form non-covalent associations with other biologically active molecules such as oligonucleotides and derivatives thereof. The use of cyclodextrins creates a water-soluble drug delivery complex, that can be modified with targeting or other functional groups. Cyclodextrin cellular delivery system for oligonucleotides described in U.S. Pat. No. 5,691,316, which is hereby incorporated by reference, are suitable for use in methods of the invention. In this system, an oligonucleotide is noncovalently complexed with a cyclodextrin, or the oligonucleotide is covalently bound to adamantine which in turn is non-covalently associated with a cyclodextrin.

The delivery molecule can include a linear cyclodextrin copolymer or a linear oxidized cyclodextrin copolymer having at least one ligand bound to the cyclodextrin copolymer. Delivery systems, as described in U.S. Pat. No. 6,509,323, herein incorporated by reference, are suitable for use in methods of the invention. An iRNA agent can be bound to the linear cyclodextrin copolymer and/or a linear oxidized cyclodextrin copolymer. Either or both of the cyclodextrin or oxidized cyclodextrin copolymers can be crosslinked to another polymer and/or bound to a ligand.

A composition for iRNA delivery can employ an "inclusion complex," a molecular compound having the characteristic structure of an adduct. In this structure, the "host molecule" spatially encloses at least part of another compound in the delivery vehicle. The enclosed compound (the "guest molecule") is situated in the cavity of the host molecule without affecting the framework structure of the host. A "host" is preferably cyclodextrin, but can be any of the molecules suggested in U.S. Patent Publ. 2003/0008818, herein incorporated by reference.

Cyclodextrins can interact with a variety of ionic and molecular species, and the resulting inclusion compounds belong to the class of "host-guest" complexes. Within the host-guest relationship, the binding sites of the host and guest molecules should be complementary in the stereoelectronic sense. A composition of the invention can contain at least one polymer and at least one therapeutic agent, generally in the form of a particulate composite of the polymer and therapeutic agent, e.g., the iRNA agent. The iRNA agent can contain one or more complexing agents. At least one polymer of the particulate composite can interact with the complexing agent in a host-guest or a guest-host interaction to form an inclusion complex between the polymer and the complexing agent. The polymer and, more particularly, the complexing agent can be used to introduce functionality into the composition. For example, at least one polymer of the particulate composite has host functionality and forms an inclusion complex with a complexing agent having guest functionality. Alternatively, at least one polymer of the particulate composite has guest functionality and forms an inclusion complex with a complexing agent having host functionality. A polymer of the particulate composite can also contain both host and guest functionalities and form inclusion complexes with guest complexing agents and host complexing agents. A polymer with functionality can, for example, facilitate cell targeting and/or cell contact (e.g., targeting or contact to a liver cell), intercellular trafficking, and/or cell entry and release.

Upon forming the particulate composite, the iRNA agent may or may not retain its biological or therapeutic activity. Upon release from the therapeutic composition, specifically, from the polymer of the particulate composite, the activity of the iRNA agent is restored. Accordingly, the particulate composite advantageously affords the iRNA agent protection against loss of activity due to, for example, degradation and offers enhanced bioavailability. Thus, a composition may be used to provide stability, particularly storage or solution stability, to an iRNA agent or any active chemical compound.

The iRNA agent may be further modified with a ligand prior to or after particulate composite or therapeutic composition formation. The ligand can provide further functionality. For example, the ligand can be a targeting moiety.

Physiological Effects

The iRNA agents described herein can be designed such that determining therapeutic toxicity is made easier by the complementarity of the iRNA agent with both a human and a non-human animal sequence. By these methods, an iRNA agent can consist of a sequence that is fully complementary to a nucleic acid sequence from a human and a nucleic acid sequence from at least one non-human animal, e.g., a non-human mammal, such as a rodent, ruminant or primate. For example, the non-human mammal can be a mouse, rat, dog, pig, goat, sheep, cow, monkey, Pan paniscus, Pan troglodytes, Macaca mulatto, or Cynomolgus monkey. The sequence of the iRNA agent could be complementary to sequences within homologous genes, e.g., oncogenes or tumor suppressor genes, of the non-human mammal and the human. By determining the toxicity of the iRNA agent in the non-human mammal, one can extrapolate the toxicity of the iRNA agent in a human. For a more strenuous toxicity test, the iRNA agent can be complementary to a human and more than one, e.g., two or three or more, non-human animals.

The methods described herein can be used to correlate any physiological effect of an iRNA agent on a human, e.g., any unwanted effect, such as a toxic effect, or any positive, or desired effect.

Delivery Module

In one aspect, the invention features a drug delivery conjugate or module, such as those described herein and those described in copending, co-owned U.S. Provisional Application Ser. No. 60/454,265, filed on Mar. 12, 2003, which is hereby incorporated by reference.

In addition, the invention includes iRNA agents described herein, e.g., a palindromic iRNA agent, an iRNA agent having a non canonical pairing, an iRNA agent which targets a gene described herein, e.g., a gene active in the liver, an iRNA agent having a chemical modification described herein, e.g., a modification which enhances resistance to degradation, an iRNA agent having an architecture or structure described herein, an iRNA agent administered as described herein, or an iRNA agent formulated as described herein, combined with, associated with, and delivered by such a drug delivery conjugate or module.

The iRNA agents can be complexed to a delivery agent that features a modular complex. The complex can include a carrier agent linked to one or more of (preferably two or more, more preferably all three of): (a) a condensing agent (e.g., an agent capable of attracting, e.g., binding, a nucleic acid, e.g., through ionic or electrostatic interactions); (b) a fusogenic agent (e.g., an agent capable of fusing and/or being transported through a cell membrane, e.g., an endosome membrane); and (c) a targeting group, e.g., a cell or tissue targeting agent, e.g., a lectin, glycoprotein, lipid or protein, e.g., an antibody, that binds to a specified cell type such as a cancer cell, endothelial cell or bone cell.

An iRNA agent, e.g., iRNA agent or sRNA agent described herein, can be linked, e.g., coupled or bound, to the modular complex. The iRNA agent can interact with the condensing agent of the complex, and the complex can be used to deliver an iRNA agent to a cell, e.g., in vitro or in vivo. For example, the complex can be used to deliver an iRNA agent to a subject in need thereof, e.g., to deliver an iRNA agent to a subject having a disorder, e.g., a disorder described herein, such as a disease or disorder of the liver.

The fusogenic agent and the condensing agent can be different agents or the one and the same agent. For example, a polyamino chain, e.g., polyethyleneimine (PEI), can be the fusogenic and/or the condensing agent.

The delivery agent can be a modular complex. For example, the complex can include a carrier agent linked to one or more of (preferably two or more, more preferably all three of):

(a) a condensing agent (e.g., an agent capable of attracting, e.g., binding, a nucleic acid, e.g., through ionic interaction), (b) a fusogenic agent (e.g., an agent capable of fusing and/or being transported through a cell membrane, e.g., an endosome membrane), and (c) a targeting group, e.g., a cell or tissue targeting agent, e.g., a lectin, glycoprotein, lipid or protein, e.g., an antibody, that binds to a specified cell type such as a cancer cell, endothelial cell, bone cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, Neproxin, or an RGD peptide or RGD peptide mimetic.

Carrier Agents

The carrier agent of a modular complex described herein can be a substrate for attachment of one or more of: a condensing agent, a fusogenic agent, and a targeting group. The carrier agent would preferably lack an endogenous enzymatic activity. The agent would preferably be a biological molecule, preferably a macromolecule. Polymeric biological carriers are preferred. It would also be preferred that the carrier molecule be biodegradable.

The carrier agent can be a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or lipid. The carrier molecule can also be a recombinant or synthetic molecule, such as a synthetic polymer, e.g., a synthetic polyamino acid. Examples of polyamino acids include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Other useful carrier molecules can be identified by routine methods.

A carrier agent can be characterized by one or more of: (a) is at least 1 Da in size; (b) has at least 5 charged groups, preferably between 5 and 5000 charged groups; (c) is present in the complex at a ratio of at least 1:1 carrier agent to fusogenic agent; (d) is present in the complex at a ratio of at least 1:1 carrier agent to condensing agent; (e) is present in the complex at a ratio of at least 1:1 carrier agent to targeting agent.

Fusogenic Agents

A fusogenic agent of a modular complex described herein can be an agent that is responsive to, e.g., changes charge depending on, the pH environment. Upon encountering the pH of an endosome, it can cause a physical change, e.g., a change in osmotic properties which disrupts or increases the permeability of the endosome membrane. Preferably, the fusogenic agent changes charge, e.g., becomes protonated, at pH lower than physiological range. For example, the fusogenic agent can become protonated at pH 4.5-6.5. The fusogenic agent can serve to release the iRNA agent into the cytoplasm of a cell after the complex is taken up, e.g., via endocytosis, by the cell, thereby increasing the cellular concentration of the iRNA agent in the cell.

In one embodiment, the fusogenic agent can have a moiety, e.g., an amino group, which, when exposed to a specified pH range, will undergo a change, e.g., in charge, e.g., protonation. The change in charge of the fusogenic agent can trigger a change, e.g., an osmotic change, in a vesicle, e.g., an endocytic vesicle, e.g., an endosome. For example, the fusogenic agent, upon being exposed to the pH environment of an endosome, will cause a solubility or osmotic change substantial enough to increase the porosity of (preferably, to rupture) the endosomal membrane.

The fusogenic agent can be a polymer, preferably a polyamino chain, e.g., polyethyleneimine (PEI). The PEI can be linear, branched, synthetic or natural. The PEI can be, e.g., alkyl substituted PEI, or lipid substituted PEI.

In other embodiments, the fusogenic agent can be polyhistidine, polyimidazole, polypyridine, polypropyleneimine, mellitin, or a polyacetal substance, e.g., a cationic polyacetal. In some embodiment, the fusogenic agent can have an alpha helical structure. The fusogenic agent can be a membrane disruptive agent, e.g., mellittin.

A fusogenic agent can have one or more of the following characteristics: (a) is at least 1 Da in size; (b) has at least 10 charged groups, preferably between 10 and 5000 charged groups, more preferably between 50 and 1000 charged groups; (c) is present in the complex at a ratio of at least 1:1 fusogenic agent to carrier agent; (d) is present in the complex at a ratio of at least 1:1 fusogenic agent to condensing agent; (e) is present in the complex at a ratio of at least 1:1 fusogenic agent to targeting agent.

Other suitable fusogenic agents can be tested and identified by a skilled artisan. The ability of a compound to respond to, e.g., change charge depending on, the pH environment can be tested by routine methods, e.g., in a cellular assay. For example, a test compound is combined or contacted with a cell, and the cell is allowed to take up the test compound, e.g., by endocytosis. An endosome preparation can then be made from the contacted cells and the endosome preparation compared to an endosome preparation from control cells. A change, e.g., a decrease, in the endosome fraction from the contacted cell vs. the control cell indicates that the test compound can function as a fusogenic agent. Alternatively, the contacted cell and control cell can be evaluated, e.g., by microscopy, e.g., by light or electron microscopy, to determine a difference in endosome population in the cells. The test compound can be labeled. In another type of assay, a modular complex described herein is constructed using one or more test or putative fusogenic agents. The modular complex can be constructed using a labeled nucleic acid instead of the iRNA. The ability of the fusogenic agent to respond to, e.g., change charge depending on, the pH environment, once the modular complex is taken up by the cell, can be evaluated, e.g., by preparation of an endosome preparation, or by microscopy techniques, as described above. A two-step assay can also be performed, wherein a first assay evaluates the ability of a test compound alone to respond to, e.g., change charge depending on, the pH environment; and a second assay evaluates the ability of a modular complex that includes the test compound to respond to, e.g., change charge depending on, the pH environment.

Condensing Agent

The condensing agent of a modular complex described herein can interact with (e.g., attracts, holds, or binds to) an iRNA agent and act to (a) condense, e.g., reduce the size or charge of the iRNA agent and/or (b) protect the iRNA agent, e.g., protect the iRNA agent against degradation. The condensing agent can include a moiety, e.g., a charged moiety, that can interact with a nucleic acid, e.g., an iRNA agent, e.g., by ionic interactions. The condensing agent would preferably be a charged polymer, e.g., a polycationic chain. The condensing agent can be a polylysine (PLL), spermine, spermidine, polyamine, pseudopeptide-polyamine, peptidomimetic polyamine, dendrimer polyamine, arginine, amidine, protamine, cationic lipid, cationic porphyrin, quarternay salt of a polyamine, or an alpha helical peptide.

A condensing agent can have the following characteristics: (a) at least 1 Da in size; (b) has at least 2 charged groups, preferably between 2 and 100 charged groups; (c) is present in the complex at a ratio of at least 1:1 condensing agent to carrier agent; (d) is present in the complex at a ratio of at least 1:1 condensing agent to fusogenic agent; (e) is present in the complex at a ratio of at least 1:1 condensing agent to targeting agent.

Other suitable condensing agents can be tested and identified by a skilled artisan, e.g., by evaluating the ability of a test agent to interact with a nucleic acid, e.g., an iRNA agent. The ability of a test agent to interact with a nucleic acid, e.g., an iRNA agent, e.g., to condense or protect the iRNA agent, can be evaluated by routine techniques. In one assay, a test agent is contacted with a nucleic acid, and the size and/or charge of the contacted nucleic acid is evaluated by a technique suitable to detect changes in molecular mass and/or charge. Such techniques include non-denaturing gel electrophoresis, immunological methods, e.g., immunoprecipitation, gel filtration, ionic interaction chromatography, and the like. A test agent is identified as a condensing agent if it changes the mass and/or charge (preferably both) of the contacted nucleic acid, compared to a control. A two-step assay can also be performed, wherein a first assay evaluates the ability of a test compound alone to interact with, e.g., bind to, e.g., condense the charge and/or mass of, a nucleic cid; and a second assay evaluates the ability of a modular complex that includes the test compound to interact with, e.g., bind to, e.g., condense the charge and/or mass of, a nucleic acid.

Amphipathic Delivery Agents

In one aspect, the invention features an amphipathic delivery conjugate or module, such as those described herein and those described in copending, co-owned U.S. Provisional Application Ser. No. 60/455,050, filed on Mar. 13, 2003, which is hereby incorporated by reference.

In addition, the invention include an iRNA agent described herein, e.g., a palindromic iRNA agent, an iRNA agent having a non canonical pairing, an iRNA agent which targets a gene described herein, e.g., a gene active in the liver, an iRNA agent having a chemical modification described herein, e.g., a modification which enhances resistance to degradation, an iRNA agent having an architecture or structure described herein, an iRNA agent administered as described herein, or an iRNA agent formulated as described herein, combined with, associated with, and delivered by such an amphipathic delivery conjugate.

An amphipathic molecule is a molecule having a hydrophobic and a hydrophilic region. Such molecules can interact with (e.g., penetrate or disrupt) lipids, e.g., a lipid bylayer of a cell. As such, they can serve as delivery agent for an associated (e.g., bound) iRNA (e.g., an iRNA or sRNA described herein). A preferred amphipathic molecule to be used in the compositions described herein (e.g., the amphipathic iRNA constructs described herein) is a polymer. The polymer may have a secondary structure, e.g., a repeating secondary structure.

One example of an amphipathic polymer is an amphipathic polypeptide, e.g., a polypeptide having a secondary structure such that the polypeptide has a hydrophilic and a hybrophobic face. The design of amphipathic peptide structures (e.g., alpha-helical polypeptides) is routine to one of skill in the art. For example, the following references provide guidance: Grell et al. (2001) *Protein design and folding: template trapping of self-assembled helical bundles* J Pept Sci 7(3): 146-51; Chen et al. (2002) *Determination of stereochemistry stability coefficients of amino acid side-chains in an amphipathic alpha-helix* J Pept Res 59(1):18-33; Iwata et al. (1994) *Design and synthesis of amphipathic 3 (10)-helical peptides and their interactions with phospholipid bilayers and ion channel formation* J Biol Chem 269(7):4928-33; Cornut et al. (1994) *The amphipathic alpha-helix concept. Application to the de novo design of ideally amphipathic Leu, Lys peptides with hemolytic activity higher than that of melittin* FEBS Lett 349(1):29-33; Negrete et al. (1998) *Deciphering the structural code for proteins: helical propensities in domain classes and statistical multiresidue information in alpha-helices*. Protein Sci 7(6):1368-79.

Another example of an amphipathic polymer is a polymer made up of two or more amphipathic subunits, e.g., two or more subunits containing cyclic moieties (e.g., a cyclic moiety having one or more hydrophilic groups and one or more hydrophobic groups). For example, the subunit may contain a steroid, e.g., cholic acid; or a aromatic moiety. Such moieties preferably can exhibit atropisomerism, such that they can form opposing hydrophobic and hydrophilic faces when in a polymer structure.

The ability of a putative amphipathic molecule to interact with a lipid membrane, e.g., a cell membrane, can be tested by routine methods, e.g., in a cell free or cellular assay. For example, a test compound is combined or contacted with a synthetic lipid bilayer, a cellular membrane fraction, or a cell, and the test compound is evaluated for its ability to interact with, penetrate or disrupt the lipid bilayer, cell membrane or cell. The test compound can labeled in order to detect the interaction with the lipid bilayer, cell membrane or cell. In another type of assay, the test compound is linked to a reporter molecule or an iRNA agent (e.g., an iRNA or sRNA described herein) and the ability of the reporter molecule or iRNA agent to penetrate the lipid bilayer, cell membrane or cell is evaluated. A two-step assay can also be performed, wherein a first assay evaluates the ability of a test compound alone to interact with a lipid bilayer, cell membrane or cell; and a second assay evaluates the ability of a construct (e.g., a construct described herein) that includes the test compound and a reporter or iRNA agent to interact with a lipid bilayer, cell membrane or cell.

An amphipathic polymer useful in the compositions described herein has at least 2, preferably at least 5, more preferably at least 10, 25, 50, 100, 200, 500, 1000, 2000, 50000 or more subunits (e.g., amino acids or cyclic subunits). A single amphipathic polymer can be linked to one or more, e.g., 2, 3, 5, 10 or more iRNA agents (e.g., iRNA or sRNA agents described herein). In some embodiments, an amphipathic polymer can contain both amino acid and cyclic subunits, e.g., aromatic subunits.

The invention features a composition that includes an iRNA agent (e.g., an iRNA or sRNA described herein) in association with an amphipathic molecule. Such compositions may be referred to herein as "amphipathic iRNA constructs." Such compositions and constructs are useful in the delivery or targeting of iRNA agents, e.g., delivery or targeting of iRNA agents to a cell. While not wanting to be bound by theory, such compositions and constructs can increase the porosity of, e.g., can penetrate or disrupt, a lipid (e.g., a lipid bilayer of a cell), e.g., to allow entry of the iRNA agent into a cell.

In one aspect, the invention relates to a composition comprising an iRNA agent (e.g., an iRNA or sRNA agent described herein) linked to an amphipathic molecule. The iRNA agent and the amphipathic molecule may be held in continuous contact with one another by either covalent or noncovalent linkages.

The amphipathic molecule of the composition or construct is preferably other than a phospholipid, e.g., other than a micelle, membrane or membrane fragment.

The amphipathic molecule of the composition or construct is preferably a polymer. The polymer may include two or more amphipathic subunits. One or more hydrophilic groups and one or more hydrophobic groups may be present on the polymer. The polymer may have a repeating secondary structure as well as a first face and a second face. The distribution of the hydrophilic groups and the hydrophobic groups along the repeating secondary structure can be such that one face of the polymer is a hydrophilic face and the other face of the polymer is a hydrophobic face.

The amphipathic molecule can be a polypeptide, e.g., a polypeptide comprising an α-helical conformation as its secondary structure.

In one embodiment, the amphipathic polymer includes one or more subunits containing one or more cyclic moiety (e.g., a cyclic moiety having one or more hydrophilic groups and/or one or more hydrophobic groups). In one embodiment, the polymer is a polymer of cyclic moieties such that the moieties have alternating hydrophobic and hydrophilic groups. For example, the subunit may contain a steroid, e.g., cholic acid. In another example, the subunit may contain an aromatic moiety. The aromatic moiety may be one that can exhibit atropisomerism, e.g., a 2,2'-bis(substituted)-1-1'-binaphthyl or a 2,2'-bis(substituted) biphenyl. A subunit may include an aromatic moiety of Formula (M):

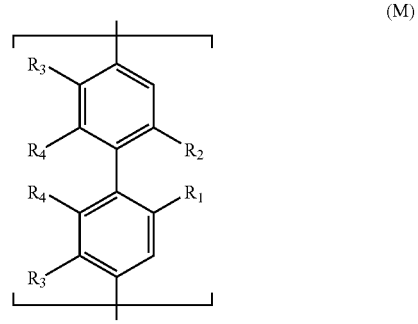

(M)

The invention features a composition that includes an iRNA agent (e.g., an iRNA or sRNA described herein) in association with an amphipathic molecule. Such compositions may be referred to herein as "amphipathic iRNA constructs." Such compositions and constructs are useful in the delivery or targeting of iRNA agents, e.g., delivery or targeting of iRNA agents to a cell. While not wanting to be bound by theory, such compositions and constructs can increase the porosity of, e.g., can penetrate or disrupt, a lipid (e.g., a lipid bilayer of a cell), e.g., to allow entry of the iRNA agent into a cell.

In one aspect, the invention relates to a composition comprising an iRNA agent (e.g., an iRNA or sRNA agent described herein) linked to an amphipathic molecule. The iRNA agent and the amphipathic molecule may be held in continuous contact with one another by either covalent or noncovalent linkages.

The amphipathic molecule of the composition or construct is preferably other than a phospholipid, e.g., other than a micelle, membrane or membrane fragment.

The amphipathic molecule of the composition or construct is preferably a polymer. The polymer may include two or more amphipathic subunits. One or more hydrophilic groups and one or more hydrophobic groups may be present on the polymer. The polymer may have a repeating secondary structure as well as a first face and a second face. The distribution of the hydrophilic groups and the hydrophobic groups along the repeating secondary structure can be such that one face of the polymer is a hydrophilic face and the other face of the polymer is a hydrophobic face.

The amphipathic molecule can be a polypeptide, e.g., a polypeptide comprising an α-helical conformation as its secondary structure.

In one embodiment, the amphipathic polymer includes one or more subunits containing one or more cyclic moiety (e.g., a cyclic moiety having one or more hydrophilic groups and/or one or more hydrophobic groups). In one embodiment, the polymer is a polymer of cyclic moieties such that the moieties have alternating hydrophobic and hydrophilic groups. For example, the subunit may contain a steroid, e.g., cholic acid. In another example, the subunit may contain an aromatic moiety. The aromatic moiety may be one that can exhibit atropisomerism, e.g., a 2,2'-bis(substituted)-1-1'-binaphthyl or a 2,2'-bis(substituted) biphenyl. A subunit may include an aromatic moiety of Formula (M):

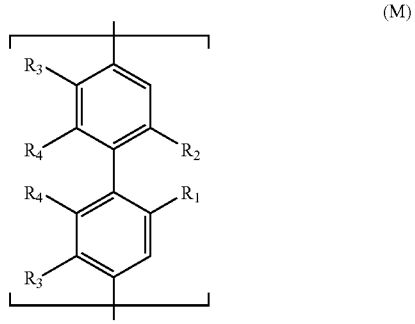

(M)

Referring to Formula M, $R_1$ is $C_1$-$C_{100}$ alkyl optionally substituted with aryl, alkenyl, alkynyl, alkoxy or halo and/or optionally inserted with O, S, alkenyl or alkynyl; $C_1$-$C_{100}$ perfluoroalkyl; or $OR_5$.

$R_2$ is hydroxy; nitro; sulfate; phosphate; phosphate ester; sulfonic acid; $OR_6$; or $C_1$-$C_{100}$ alkyl optionally substituted with hydroxy, halo, nitro, aryl or alkyl sulfinyl, aryl or alkyl sulfonyl, sulfate, sulfonic acid, phosphate, phosphate ester, substituted or unsubstituted aryl, carboxyl, carboxylate, amino carbonyl, or alkoxycarbonyl, and/or optionally inserted with O, NH, S, S(O), $SO_2$, alkenyl, or alkynyl.

$R_3$ is hydrogen, or when taken together with $R_4$ froms a fused phenyl ring.

$R_4$ is hydrogen, or when taken together with $R_3$ froms a fused phenyl ring.

$R_5$ is $C_1$-$C_{100}$ alkyl optionally substituted with aryl, alkenyl, alkynyl, alkoxy or halo and/or optionally inserted with O, S, alkenyl or alkynyl; or $C_1$-$C_{100}$ perfluoroalkyl; and $R_6$ is $C_1$-$C_{100}$ alkyl optionally substituted with hydroxy, halo, nitro, aryl or alkyl sulfinyl, aryl or alkyl sulfonyl, sulfate, sulfonic acid, phosphate, phosphate ester, substituted or unsubstituted aryl, carboxyl, carboxylate, amino carbonyl, or alkoxycarbonyl, and/or optionally inserted with O, NH, S, S(O), $SO_2$, alkenyl, or alkynyl.

Increasing Cellular Uptake of dsRNAs

A method of the invention that can include the administration of an iRNA agent and a drug that affects the uptake of the iRNA agent into the cell. The drug can be administered before, after, or at the same time that the iRNA agent is administered. The drug can be covalently linked to the iRNA agent. The drug can be, for example, a lipopolysaccharide, an activator of p38 MAP kinase, or an activator of NF-κB. The drug can have a transient effect on the cell.

The drug can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The drug can also increase the uptake of the iRNA agent into the cell by activating an inflammatory response, for example. Exemplary drug's that would have such an effect include tumor necrosis factor alpha (TNFalpha), interleukin-1 beta, or gamma interferon.

iRNA Conjugates

An iRNA agent can be coupled, e.g., covalently coupled, to a second agent. For example, an iRNA agent used to treat a particular disorder can be coupled to a second therapeutic agent, e.g., an agent other than the iRNA agent. The second therapeutic agent can be one which is directed to the treatment of the same disorder. For example, in the case of an iRNA used to treat a disorder characterized by unwanted cell proliferation, e.g., cancer, the iRNA agent can be coupled to a second agent which has an anti-cancer effect. For example, it can be coupled to an agent which stimulates the immune system, e.g., a CpG motif, or more generally an agent that activates a toll-like receptor and/or increases the production of gamma interferon.

iRNA Production

An iRNA can be produced, e.g., in bulk, by a variety of methods. Exemplary methods include: organic synthesis and RNA cleavage, e.g., in vitro cleavage.

Organic Synthesis

An iRNA can be made by separately synthesizing each respective strand of a double-stranded RNA molecule. The component strands can then be annealed.

A large bioreactor, e.g., the OligoPilot II from Pharmacia Biotec AB (Uppsala Sweden), can be used to produce a large amount of a particular RNA strand for a given iRNA. The OligoPilotII reactor can efficiently couple a nucleotide using only a 1.5 molar excess of a phosphoramidite nucleotide. To make an RNA strand, ribonucleotides amidites are used. Standard cycles of monomer addition can be used to synthesize the 21 to 23 nucleotide strand for the iRNA. Typically, the two complementary strands are produced separately and then annealed, e.g., after release from the solid support and deprotection.

Organic synthesis can be used to produce a discrete iRNA species. The complementary of the species to a particular target gene can be precisely specified. For example, the species may be complementary to a region that includes a polymorphism, e.g., a single nucleotide polymorphism. Further the location of the polymorphism can be precisely defined. In some embodiments, the polymorphism is located in an internal region, e.g., at least 4, 5, 7, or 9 nucleotides from one or both of the termini.

dsRNA Cleavage iRNAs can also be made by cleaving a larger ds iRNA. The cleavage can be mediated in vitro or in vivo. For example, to produce iRNAs by cleavage in vitro, the following method can be used:

In vitro transcription. dsRNA is produced by transcribing a nucleic acid (DNA) segment in both directions. For example, the HiScribe™ RNAi transcription kit (New England Biolabs) provides a vector and a method for producing a dsRNA for a nucleic acid segment that is cloned into the vector at a position flanked on either side by a T7 promoter. Separate templates are generated for T7 transcription of the two complementary strands for the dsRNA. The templates are transcribed in vitro by addition of T7 RNA polymerase and dsRNA is produced. Similar methods using PCR and/or other RNA polymerases (e.g., T3 or SP6 polymerase) can also be used. In one embodiment, RNA generated by this method is carefully purified to remove endotoxins that may contaminate preparations of the recombinant enzymes.

In vitro cleavage. dsRNA is cleaved in vitro into iRNAs, for example, using a Dicer or comparable RNAse III-based activity. For example, the dsRNA can be incubated in an in vitro extract from *Drosophila* or using purified components, e.g. a purified RNAse or RISC complex (RNA-induced silencing complex). See, e.g., Ketting et al. *Genes Dev* 2001 Oct. 15; 15(20):2654-9. and Hammond *Science* 2001 Aug. 10; 293 (5532):1146-50.

dsRNA cleavage generally produces a plurality of iRNA species, each being a particular 21 to 23 nt fragment of a source dsRNA molecule. For example, iRNAs that include sequences complementary to overlapping regions and adjacent regions of a source dsRNA molecule may be present.

Regardless of the method of synthesis, the iRNA preparation can be prepared in a solution (e.g., an aqueous and/or organic solution) that is appropriate for formulation. For example, the iRNA preparation can be precipitated and redissolved in pure double-distilled water, and lyophilized. The dried iRNA can then be resuspended in a solution appropriate for the intended formulation process.

Synthesis of modified and nucleotide surrogate iRNA agents is discussed below.

Formulation

The iRNA agents described herein can be formulated for administration to a subject For ease of exposition the formulations, compositions and methods in this section are discussed largely with regard to unmodified iRNA agents. It should be understood, however, that these formulations, compositions and methods can be practiced with other iRNA agents, e.g., modified iRNA agents, and such practice is within the invention.

A formulated iRNA composition can assume a variety of states. In some examples, the composition is at least partially crystalline, uniformly crystalline, and/or anhydrous (e.g., less than 80, 50, 30, 20, or 10% water). In another example, the iRNA is in an aqueous phase, e.g., in a solution that includes water.

The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the iRNA composition is formulated in a manner that is compatible with the intended method of administration (see, below).

In particular embodiments, the composition is prepared by at least one of the following methods: spray drying, lyophilization, vacuum drying, evaporation, fluid bed drying, or a combination of these techniques; or sonication with a lipid, freeze-drying, condensation and other self-assembly.

A iRNA preparation can be formulated in combination with another agent, e.g., another therapeutic agent or an agent that stabilizes a iRNA, e.g., a protein that complexes with iRNA to form an iRNP. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the iRNA preparation includes another iRNA agent, e.g., a second iRNA that can mediated RNAi with respect to a second gene, or with respect to the same gene. Still other preparation can include at least 3, 5, ten, twenty, fifty, or a hundred or more different iRNA species. Such iRNAs can mediated RNAi with respect to a similar number of different genes.

In one embodiment, the iRNA preparation includes at least a second therapeutic agent (e.g., an agent other than an RNA or a DNA). For example, a iRNA composition for the treatment of a viral disease, e.g. HIV, might include a known antiviral agent (e.g., a protease inhibitor or reverse transcriptase inhibitor). In another example, a iRNA composition for the treatment of a cancer might further comprise a chemotherapeutic agent.

Exemplary formulations are discussed below:

Liposomes

For ease of exposition the formulations, compositions and methods in this section are discussed largely with regard to unmodified iRNA agents. It should be understood, however, that these formulations, compositions and methods can be practiced with other iRNA agents, e.g., modified iRNA s agents, and such practice is within the invention. An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) preparation can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNAi. In some cases the liposomes are also specifically targeted, e.g., to direct the iRNA to particular cell types.

A liposome containing a iRNA can be prepared by a variety of methods.

In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA preparation is then added to the micelles that include the lipid component. The cationic groups on the lipid interact with the iRNA and condense around the iRNA to form a liposome. After condensation, the detergent is removed, e.g., by dialysis, to yield a liposomal preparation of iRNA.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Further description of methods for producing stable polynucleotide delivery vehicles, which incorporate a polynucleotide/cationic lipid complex as structural components of the delivery vehicle, are described in, e.g., WO 96/37194. Liposome formation can also include one or more aspects of exemplary methods described in Felgner, P. L. et al., Proc. Natl. Acad. Sci., USA 8:7413-7417, 1987; U.S. Pat. Nos. 4,897,355; 5,171,678; Bangham, et al. M. Mol. Biol. 23:238, 1965; Olson, et al. Biochim. Biophys. Acta 557:9, 1979; Szoka, et al. Proc. Natl. Acad. Sci. 75: 4194, 1978; Mayhew, et al. Biochim. Biophys. Acta 775:169, 1984; Kim, et al. Biochim. Biophys. Acta 728:339, 1983; and Fukunaga, et al. Endocrinol. 115:757, 1984. Commonly used techniques for preparing lipid aggregates of appropriate size for use as delivery vehicles include sonication and freeze-thaw plus extrusion (see, e.g., Mayer, et al. Biochim. Biophys. Acta 858:161, 1986). Microfluidization can be used when consistently small (50 to 200 nm) and relatively uniform aggregates are desired (Mayhew, et al. Biochim. Biophys. Acta 775:169, 1984). These methods are readily adapted to packaging iRNA preparations into liposomes.

Liposomes that are pH-sensitive or negatively-charged, entrap nucleic acid molecules rather than complex with them. Since both the nucleic acid molecules and the lipid are similarly charged, repulsion rather than complex formation occurs. Nevertheless, some nucleic acid molecules are entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 19, (1992) 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, J. Biol. Chem. 269:2550, 1994; Nabel, Proc. Natl. Acad. Sci. 90:11307, 1993; Nabel, Human Gene Ther. 3:649, 1992; Gershon, Biochem. 32:7143, 1993; and Strauss EMBO J. 11:417, 1992.

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNAs to macrophages.

Further advantages of liposomes include: liposomes obtained from natural phospholipids are biocompatible and biodegradable; liposomes can incorporate a wide range of water and lipid soluble drugs; liposomes can protect encapsulated iRNAs in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA, into the skin. In some implementations, liposomes are used for delivering iRNA to epidermal cells and also to enhance the penetration of iRNA into dermal tissues, e.g., into skin. For example, the liposomes can be applied topically. Topical delivery of drugs formulated as liposomes to the skin has been documented (see, e.g., Weiner et al., *Journal of Drug Targeting*, 1992, vol. 2,405-410 and du Plessis et al., *Antiviral Research*, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149: 157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with iRNA are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNA can be delivered, for example, subcutaneously by infection in order to deliver iRNA to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading. The iRNA agents can include an RRMS tethered to a moiety which improves association with a liposome.

Surfactants

For ease of exposition the formulations, compositions and methods in this section are discussed largely with regard to unmodified iRNA agents. It should be understood, however, that these formulations, compositions and methods can be practiced with other iRNA agents, e.g., modified iRNA agents, and such practice is within the invention. Surfactants find wide application in formulations such as emulsions (including microemulsions) and liposomes (see above). iRNA (or a precursor, e.g., a larger dsRNA which can be processed into a iRNA, or a DNA which encodes a iRNA or precursor) compositions can include a surfactant. In one embodiment, the iRNA is formulated as an emulsion that includes a surfactant. The most common way of classifying and ranking the properties of the many different types of surfactants, both natural and synthetic, is by the use of the hydrophile/lipophile balance (HLB). The nature of the hydrophilic group provides the most useful means for categorizing the different surfactants used in formulations (Rieger, in "Pharmaceutical Dosage Forms," Marcel Dekker, Inc., New York, N.Y., 1988, p. 285).

If the surfactant molecule is not ionized, it is classified as a nonionic surfactant. Nonionic surfactants find wide application in pharmaceutical products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms," Marcel Dekker, Inc., New York, N.Y., 1988, p. 285).

Micelles and Other Membranous Formulations

For ease of exposition the micelles and other formulations, compositions and methods in this section are discussed largely with regard to unmodified iRNA agents. It should be understood, however, that these micelles and other formulations, compositions and methods can be practiced with other iRNA agents, e.g., modified iRNA agents, and such practice is within the invention. The iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof)) composition can be provided as a micellar formulation. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the iRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing is preferred in order to provide smaller size micelles.

In one method a first micellar composition is prepared which contains the iRNA composition and at least the alkali metal alkyl sulphate. The first micellar composition is then mixed with at least three micelle forming compounds to form a mixed micellar composition. In another method, the micellar composition is prepared by mixing the iRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e. there is one phase. If there are two phases, it is necessary to shake the dispenser prior to dispensing a portion of the contents, e.g. through a metered valve. The dispensed dose of pharmaceutical agent is propelled from the metered valve in a fine spray.

The preferred propellants are hydrogen-containing chlorofluorocarbons, hydrogen-containing fluorocarbons, dimethyl ether and diethyl ether. Even more preferred is HFA 134a (1,1,1,2 tetrafluoroethane).

The specific concentrations of the essential ingredients can be determined by relatively straightforward experimentation. For absorption through the oral cavities, it is often desirable to increase, e.g. at least double or triple, the dosage for through injection or administration through the gastrointestinal tract.

The iRNA agents can include an RRMS tethered to a moiety which improves association with a micelle or other membranous formulation.

Particles

For ease of exposition the particles, formulations, compositions and methods in this section are discussed largely with regard to unmodified iRNA agents. It should be understood, however, that these particles, formulations, compositions and methods can be practiced with other iRNA agents, e.g., modified iRNA agents, and such practice is within the invention. In another embodiment, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) preparations may be incorporated into a particle, e.g., a microparticle. Microparticles can be produced by spray-drying, but may also be produced by other methods including lyophilization, evaporation, fluid bed drying, vacuum drying, or a combination of these techniques. See below for further description.

Sustained-Release Formulations. An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) described herein can be formulated for controlled, e.g., slow release. Controlled release can be achieved by disposing the iRNA within a structure or substance which impedes its release. E.g., iRNA can be disposed within a porous matrix or in an erodable matrix, either of which allow release of the iRNA over a period of time.

Polymeric particles, e.g., polymeric in microparticles can be used as a sustained-release reservoir of iRNA that is taken up by cells only released from the microparticle through biodegradation. The polymeric particles in this embodiment should therefore be large enough to preclude phagocytosis (e.g., larger than 10 µm and preferably larger than 20 µm). Such particles can be produced by the same methods to make smaller particles, but with less vigorous mixing of the first and second emulsions. That is to say, a lower homogenization speed, vortex mixing speed, or sonication setting can be used to obtain particles having a diameter around 100 µm rather than 10 µm. The time of mixing also can be altered.

Larger microparticles can be formulated as a suspension, a powder, or an implantable solid, to be delivered by intramuscular, subcutaneous, intradermal, intravenous, or intraperitoneal injection; via inhalation (intranasal or intrapulmonary); orally; or by implantation. These particles are useful for delivery of any iRNA when slow release over a relatively long term is desired. The rate of degradation, and consequently of release, varies with the polymeric formulation.

Microparticles preferably include pores, voids, hollows, defects or other interstitial spaces that allow the fluid suspension medium to freely permeate or perfuse the particulate boundary. For example, the perforated microstructures can be used to form hollow, porous spray dried microspheres.

Polymeric particles containing iRNA (e.g., a sRNA) can be made using a double emulsion technique, for instance. First, the polymer is dissolved in an organic solvent. A preferred polymer is polylactic-co-glycolic acid (PLGA), with a lactic/glycolic acid weight ratio of 65:35, 50:50, or 75:25. Next, a sample of nucleic acid suspended in aqueous solution is added to the polymer solution and the two solutions are mixed to form a first emulsion. The solutions can be mixed by vortexing or shaking, and in a preferred method, the mixture can be sonicated. Most preferable is any method by which the nucleic acid receives the least amount of damage in the form of nicking, shearing, or degradation, while still allowing the formation of an appropriate emulsion. For example, acceptable results can be obtained with a Vibra-cell model VC-250 sonicator with a ⅛" microtip probe, at setting #3.

Spray-Drying. An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof)) can be prepared by spray drying. Spray dried iRNA can be administered to a subject or be subjected to further formulation. A pharmaceutical composition of iRNA can be prepared by spray drying a homogeneous aqueous mixture that includes a iRNA under conditions sufficient to provide a dispersible powdered composition, e.g., a pharmaceutical composition. The material for spray drying can also include one or more of: a pharmaceutically acceptable excipient, or a dispersibility-enhancing amount of a physiologically acceptable, water-soluble protein. The spray-dried product can be a dispersible powder that includes the iRNA.

Spray drying is a process that converts a liquid or slurry material to a dried particulate form. Spray drying can be used to provide powdered material for various administrative routes including inhalation. See, for example, M. Sacchetti and M. M. Van Oort in: Inhalation Aerosols Physical and Biological Basis for Therapy, A. J. Hickey, ed. Marcel Dekkar, New York, 1996.

Spray drying can include atomizing a solution, emulsion, or suspension to form a fine mist of droplets and drying the droplets. The mist can be projected into a drying chamber (e.g., a vessel, tank, tubing, or coil) where it contacts a drying gas. The mist can include solid or liquid pore forming agents. The solvent and pore forming agents evaporate from the droplets into the drying gas to solidify the droplets, simultaneously forming pores throughout the solid. The solid (typically in a powder, particulate form) then is separated from the drying gas and collected.

Spray drying includes bringing together a highly dispersed liquid, and a sufficient volume of air (e.g., hot air) to produce evaporation and drying of the liquid droplets. The preparation to be spray dried can be any solution, course suspension, slurry, colloidal dispersion, or paste that may be atomized using the selected spray drying apparatus. Typically, the feed is sprayed into a current of warm filtered air that evaporates the solvent and conveys the dried product to a collector. The spent air is then exhausted with the solvent. Several different types of apparatus may be used to provide the desired product. For example, commercial spray dryers manufactured by Buchi Ltd. or Niro Corp. can effectively produce particles of desired size.

Spray-dried powdered particles can be approximately spherical in shape, nearly uniform in size and frequently hollow. There may be some degree of irregularity in shape depending upon the incorporated medicament and the spray drying conditions. In many instances the dispersion stability of spray-dried microspheres appears to be more effective if an inflating agent (or blowing agent) is used in their production. Particularly preferred embodiments may comprise an emulsion with an inflating agent as the disperse or continuous phase (the other phase being aqueous in nature). An inflating agent is preferably dispersed with a surfactant solution, using, for instance, a commercially available microfluidizer at a pressure of about 5000 to 15,000 psi. This process forms an emulsion, preferably stabilized by an incorporated surfactant, typically comprising submicron droplets of water immiscible blowing agent dispersed in an aqueous continuous phase. The formation of such dispersions using this and other techniques are common and well known to those in the art. The blowing agent is preferably a fluorinated compound (e.g. perfluorohexane, perfluorooctyl bromide, perfluorodecalin, perfluorobutyl ethane) which vaporizes during the spray-drying process, leaving behind generally hollow, porous aerodynamically light microspheres. As will be discussed in more detail below, other suitable blowing agents include chloroform, freons, and hydrocarbons. Nitrogen gas and carbon dioxide are also contemplated as a suitable blowing agent.

Although the perforated microstructures are preferably formed using a blowing agent as described above, it will be appreciated that, in some instances, no blowing agent is required and an aqueous dispersion of the medicament and surfactant(s) are spray dried directly. In such cases, the formulation may be amenable to process conditions (e.g., elevated temperatures) that generally lead to the formation of hollow, relatively porous microparticles. Moreover, the medicament may possess special physicochemical properties (e.g., high crystallinity, elevated melting temperature, surface activity, etc.) that make it particularly suitable for use in such techniques.

The perforated microstructures may optionally be associated with, or comprise, one or more surfactants. Moreover, miscible surfactants may optionally be combined with the suspension medium liquid phase. It will be appreciated by those skilled in the art that the use of surfactants may further increase dispersion stability, simplify formulation procedures or increase bioavailability upon administration. Of course combinations of surfactants, including the use of one or more in the liquid phase and one or more associated with the perforated microstructures are contemplated as being within the scope of the invention. By "associated with or comprise" it is meant that the structural matrix or perforated microstructure may incorporate, adsorb, absorb, be coated with or be formed by the surfactant.

Surfactants suitable for use include any compound or composition that aids in the formation and maintenance of the stabilized respiratory dispersions by forming a layer at the interface between the structural matrix and the suspension medium. The surfactant may comprise a single compound or any combination of compounds, such as in the case of co-surfactants. Particularly preferred surfactants are substantially insoluble in the propellant, nonfluorinated, and selected from the group consisting of saturated and unsaturated lipids, nonionic detergents, nonionic block copolymers, ionic surfactants, and combinations of such agents. It should be emphasized that, in addition to the aforementioned surfactants, suitable (i.e. biocompatible) fluorinated surfactants are compatible with the teachings herein and may be used to provide the desired stabilized preparations.

Lipids, including phospholipids, from both natural and synthetic sources may be used in varying concentrations to form a structural matrix. Generally, compatible lipids comprise those that have a gel to liquid crystal phase transition greater than about 40° C. Preferably, the incorporated lipids are relatively long chain (i.e. $C_6$-$C_{22}$) saturated lipids and more preferably comprise phospholipids. Exemplary phospholipids useful in the disclosed stabilized preparations comprise egg phosphatidylcholine, dilauroylphosphatidylcholine, dioleylphosphatidylcholine, dipalmitoylphosphatidylcholine, disteroylphosphatidylcholine, short-chain phosphatidylcholines, phosphatidylethanolamine, dioleylphosphatidylethanolamine, phosphatidylserine, phosphatidylglycerol, phosphatidylinositol, glycolipids, ganglioside GM1, sphingomyelin, phosphatidic acid, cardiolipin; lipids bearing polymer chains such as, polyethylene glycol, chitin, hyaluronic acid, or polyvinylpyrrolidone; lipids bearing sulfonated mono-, di-, and polysaccharides; fatty acids such as palmitic acid, stearic acid, and oleic acid; cholesterol, cholesterol esters, and cholesterol hemisuccinate. Due to their excellent biocompatibility characteristics, phospholipids and combinations of phospholipids and poloxamers are particularly suitable for use in the stabilized dispersions disclosed herein.

Compatible nonionic detergents comprise: sorbitan esters including sorbitan trioleate (Spans™ 85), sorbitan sesquioleate, sorbitan monooleate, sorbitan monolaurate, polyoxyethylene (20) sorbitan monolaurate, and polyoxyethylene (20) sorbitan monooleate, oleyl polyoxyethylene (2) ether, stearyl polyoxyethylene (2) ether, lauryl polyoxyethylene (4) ether, glycerol esters, and sucrose esters. Other suitable nonionic detergents can be easily identified using McCutcheon’s Emulsifiers and Detergents (McPublishing Co., Glen Rock, N.J.). Preferred block copolymers include diblock and triblock copolymers of polyoxyethylene and polyoxypropylene, including poloxamer 188 (Pluronic.RTM. F68), poloxamer 407 (Pluronic.RTM. F-127), and poloxamer 338. Ionic surfactants such as sodium sulfosuccinate, and fatty acid soaps may also be utilized. In preferred embodiments, the microstructures may comprise oleic acid or its alkali salt.

In addition to the aforementioned surfactants, cationic surfactants or lipids are preferred especially in the case of delivery of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof). Examples of suitable cationic lipids include: DOTMA, N—[-(2,3-dioleyloxy)propyl]-N,N,N-trimethylammonium-chloride; DOTAP,1,2-dioleyloxy-3-(trimethylammonio)propane; and DOTB, 1,2-dioleyl-3-(4'-trimethylammonio)butanoyl-sn-glycerol. Polycationic amino acids such as polylysine, and polyarginine are also contemplated.

For the spraying process, such spraying methods as rotary atomization, pressure atomization and two-fluid atomization can be used. Examples of the devices used in these processes include "Parubisu [phonetic rendering] Mini-Spray GA-32" and "Parubisu Spray Drier DL-41", manufactured by Yamato Chemical Co., or "Spray Drier CL-8," "Spray Drier L-8," "Spray Drier FL-12," "Spray Drier FL-16" or "Spray Drier FL-20," manufactured by Okawara Kakoki Co., can be used for the method of spraying using rotary-disk atomizer.

While no particular restrictions are placed on the gas used to dry the sprayed material, it is recommended to use air, nitrogen gas or an inert gas. The temperature of the inlet of the gas used to dry the sprayed materials such that it does not cause heat deactivation of the sprayed material. The range of temperatures may vary between about 50° C. to about 200° C., preferably between about 50° C. and 100° C. The temperature of the outlet gas used to dry the sprayed material, may vary between about 0° C. and about 150° C., preferably between 0° C. and 90° C., and even more preferably between 0° C. and 60° C.

The spray drying is done under conditions that result in substantially amorphous powder of homogeneous constitution having a particle size that is respirable, a low moisture content and flow characteristics that allow for ready aerosolization. Preferably the particle size of the resulting powder is such that more than about 98% of the mass is in particles having a diameter of about 10 μm or less with about 90% of the mass being in particles having a diameter less than 5 μm. Alternatively, about 95% of the mass will have particles with a diameter of less than 10 μm with about 80% of the mass of the particles having a diameter of less than 5 μm.

The dispersible pharmaceutical-based dry powders that include the iRNA preparation may optionally be combined with pharmaceutical carriers or excipients which are suitable for respiratory and pulmonary administration. Such carriers may serve simply as bulking agents when it is desired to reduce the iRNA concentration in the powder which is being delivered to a patient, but may also serve to enhance the stability of the iRNA compositions and to improve the dispersibility of the powder within a powder dispersion device in order to provide more efficient and reproducible delivery of the iRNA and to improve handling characteristics of the iRNA such as flowability and consistency to facilitate manufacturing and powder filling.

Such carrier materials may be combined with the drug prior to spray drying, i.e., by adding the carrier material to the purified bulk solution. In that way, the carrier particles will be formed simultaneously with the drug particles to produce a homogeneous powder. Alternatively, the carriers may be separately prepared in a dry powder form and combined with the dry powder drug by blending. The powder carriers will usually be crystalline (to avoid water absorption), but might in some cases be amorphous or mixtures of crystalline and amorphous. The size of the carrier particles may be selected to improve the flowability of the drug powder, typically being in the range from 25 μm to 100 μm. A preferred carrier material is crystalline lactose having a size in the above-stated range.

Powders prepared by any of the above methods will be collected from the spray dryer in a conventional manner for subsequent use. For use as pharmaceuticals and other purposes, it will frequently be desirable to disrupt any agglomerates which may have formed by screening or other conventional techniques. For pharmaceutical uses, the dry powder formulations will usually be measured into a single dose, and the single dose sealed into a package. Such packages are particularly useful for dispersion in dry powder inhalers, as described in detail below. Alternatively, the powders may be packaged in multiple-dose containers.

Methods for spray drying hydrophobic and other drugs and components are described in U.S. Pat. Nos. 5,000,888; 5,026,550; 4,670,419, 4,540,602; and 4,486,435. Bloch and Speison (1983) Pharm. Acta Helv 58:14-22 teaches spray drying of hydrochlorothiazide and chlorthalidone (lipophilic drugs) and a hydrophilic adjuvant (pentaerythritol) in azeotropic solvents of dioxane-water and 2-ethoxyethanol-water. A number of Japanese Patent application Abstracts relate to spray drying of hydrophilic-hydrophobic product combinations, including JP 806766; JP 7242568; JP 7101884; JP 7101883; JP 71018982; JP 7101881; and JP 4036233. Other foreign patent publications relevant to spray drying hydrophilic-hydrophobic product combinations include FR 2594693; DE 2209477; and WO 88/07870.

Lyophilization.

An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) preparation can be made by lyophilization. Lyophilization is a freeze-drying process in which water is sublimed from the composition after it is frozen. The particular advantage associated with the lyophilization process is that biologicals and pharmaceuticals that are relatively unstable in an aqueous solution can be dried without elevated temperatures (thereby eliminating the adverse thermal effects), and then stored in a dry state where there are few stability problems. With respect to the instant invention such techniques are particularly compatible with the incorporation of nucleic acids in perforated microstructures without compromising physiological activity. Methods for providing lyophilized particulates are known to those of skill in the art and it would clearly not require undue experimentation to provide dispersion compatible microstructures in accordance with the teachings herein. Accordingly, to the extent that lyophilization processes may be used to provide microstructures having the desired porosity and size, they are conformance with the teachings herein and are expressly contemplated as being within the scope of the instant invention.

Targeting

For ease of exposition the formulations, compositions and methods in this section are discussed largely with regard to unmodified iRNAs. It should be understood, however, that these formulations, compositions and methods can be practiced with other iRNA agents, e.g., modified iRNA agents, and such practice is within the invention.

In some embodiments, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) is targeted to a particular cell. For example, a liposome or particle or other structure that includes a iRNA can also include a targeting moiety that recognizes a specific molecule on a target cell. The targeting moiety can be a molecule with a specific affinity for a target cell. Targeting moieties can include antibodies directed against a protein found on the surface of a target cell, or the ligand or a receptor-binding portion of a ligand for a molecule found on the surface of a target cell. For example, the targeting moiety can recognize a cancer-specific antigen (e.g., CA15-3, CA19-9, CEA, or HER2/neu.) or a viral antigen, thus delivering the iRNA to a cancer cell or a virus-infected cell. Exemplary targeting moieties include antibodies (such as IgM, IgG, IgA, IgD, and the like, or a functional portions thereof), ligands for cell surface receptors (e.g., ectodomains thereof).

Table 3 provides a number of antigens which can be used to target selected cells.

TABLE 3

| ANTIGEN | Exemplary tumor tissue |
| --- | --- |
| CEA (carcinoembryonic antigen) | colon, breast, lung |
| PSA (prostate specific antigen) | prostate cancer |
| CA-125 | ovarian cancer |
| CA 15-3 | breast cancer |
| CA 19-9 | breast cancer |
| HER2/neu | breast cancer |
| α-feto protein | testicular cancer, hepatic cancer |
| β-HCG (human chorionic gonadotropin) | testicular cancer, choriocarcinoma |
| MUC-1 | breast cancer |
| Estrogen receptor | breast cancer, uterine cancer |
| Progesterone receptor | breast cancer, uterine cancer |
| EGFr (epidermal growth factor receptor) | bladder cancer |

In one embodiment, the targeting moiety is attached to a liposome. For example, U.S. Pat. No. 6,245,427 describes a method for targeting a liposome using a protein or peptide. In another example, a cationic lipid component of the liposome is derivatized with a targeting moiety. For example, WO 96/37194 describes converting N-glutaryldioleoylphosphatidyl ethanolamine to a N-hydroxysuccinimide activated ester. The product was then coupled to an RGD peptide.

Genes and Diseases

In one aspect, the invention features, a method of treating a subject at risk for or afflicted with unwanted cell proliferation, e.g., malignant or nonmalignant cell proliferation. The method includes:

providing an iRNA agent, e.g., an sRNA or iRNA agent described herein, e.g., an iRNA having a structure described herein, where the iRNA is homologous to and can silence, e.g., by cleavage, a gene which promotes unwanted cell proliferation;

administering an iRNA agent, e.g., an sRNA or iRNA agent described herein to a subject, preferably a human subject, thereby treating the subject.

In a preferred embodiment the gene is a growth factor or growth factor receptor gene, a kinase, e.g., a protein tyrosine, serine or threonine kinase gene, an adaptor protein gene, a gene encoding a G protein superfamily molecule, or a gene encoding a transcription factor.

In a preferred embodiment the iRNA agent silences the PDGF beta gene, and thus can be used to treat a subject having or at risk for a disorder characterized by unwanted PDGF beta expression, e.g., testicular and lung cancers.

In another preferred embodiment the iRNA agent silences the Erb-B gene, and thus can be used to treat a subject having or at risk for a disorder characterized by unwanted Erb-B expression, e.g., breast cancer.

In a preferred embodiment the iRNA agent silences the Src gene, and thus can be used to treat a subject having or at risk for a disorder characterized by unwanted Src expression, e.g., colon cancers.

In a preferred embodiment the iRNA agent silences the CRK gene, and thus can be used to treat a subject having or at risk for a disorder characterized by unwanted CRK expression, e.g., colon and lung cancers.

In a preferred embodiment the iRNA agent silences the GRB2 gene, and thus can be used to treat a subject having or at risk for a disorder characterized by unwanted GRB2 expression, e.g., squamous cell carcinoma.

In another preferred embodiment the iRNA agent silences the RAS gene, and thus can be used to treat a subject having or at risk for a disorder characterized by unwanted RAS expression, e.g., pancreatic, colon and lung cancers, and chronic leukemia.

In another preferred embodiment the iRNA agent silences the MEKK gene, and thus can be used to treat a subject having or at risk for a disorder characterized by unwanted MEKK expression, e.g., squamous cell carcinoma, melanoma or leukemia.

In another preferred embodiment the iRNA agent silences the JNK gene, and thus can be used to treat a subject having or at risk for a disorder characterized by unwanted JNK expression, e.g., pancreatic or breast cancers.

In a preferred embodiment the iRNA agent silences the RAF gene, and thus can be used to treat a subject having or at risk for a disorder characterized by unwanted RAF expression, e.g., lung cancer or leukemia.

In a preferred embodiment the iRNA agent silences the Erk1/2 gene, and thus can be used to treat a subject having or at risk for a disorder characterized by unwanted Erk1/2 expression, e.g., lung cancer.

In another preferred embodiment the iRNA agent silences the PCNA (p21) gene, and thus can be used to treat a subject having or at risk for a disorder characterized by unwanted PCNA expression, e.g., lung cancer.

In a preferred embodiment the iRNA agent silences the MYB gene, and thus can be used to treat a subject having or at risk for a disorder characterized by unwanted MYB expression, e.g., colon cancer or chronic myelogenous leukemia.

In a preferred embodiment the iRNA agent silences the c-MYC gene, and thus can be used to treat a subject having or at risk for a disorder characterized by unwanted c-MYC expression, e.g., Burkitt's lymphoma or neuroblastoma.

In another preferred embodiment the iRNA agent silences the JUN gene, and thus can be used to treat a subject having or at risk for a disorder characterized by unwanted JUN expression, e.g., ovarian, prostate or breast cancers.

In another preferred embodiment the iRNA agent silences the FOS gene, and thus can be used to treat a subject having or at risk for a disorder characterized by unwanted FOS expression, e.g., skin or prostate cancers.

In a preferred embodiment the iRNA agent silences the BCL-2 gene, and thus can be used to treat a subject having or at risk for a disorder characterized by unwanted BCL-2 expression, e.g., lung or prostate cancers or Non-Hodgkin lymphoma.

In a preferred embodiment the iRNA agent silences the Cyclin D gene, and thus can be used to treat a subject having or at risk for a disorder characterized by unwanted Cyclin D expression, e.g., esophageal and colon cancers.

In a preferred embodiment the iRNA agent silences the VEGF gene, and thus can be used to treat a subject having or at risk for a disorder characterized by unwanted VEGF expression, e.g., esophageal and colon cancers.

In a preferred embodiment the iRNA agent silences the EGFR gene, and thus can be used to treat a subject having or at risk for a disorder characterized by unwanted EGFR expression, e.g., breast cancer.

In another preferred embodiment the iRNA agent silences the Cyclin A gene, and thus can be used to treat a subject having or at risk for a disorder characterized by unwanted Cyclin A expression, e.g., lung and cervical cancers.

In another preferred embodiment the iRNA agent silences the Cyclin E gene, and thus can be used to treat a subject having or at risk for a disorder characterized by unwanted Cyclin E expression, e.g., lung and breast cancers.

In another preferred embodiment the iRNA agent silences the WNT-1 gene, and thus can be used to treat a subject having or at risk for a disorder characterized by unwanted WNT-1 expression, e.g., basal cell carcinoma.

In another preferred embodiment the iRNA agent silences the beta-catenin gene, and thus can be used to treat a subject having or at risk for a disorder characterized by unwanted beta-catenin expression, e.g., adenocarcinoma or hepatocellular carcinoma.

In another preferred embodiment the iRNA agent silences the c-MET gene, and thus can be used to treat a subject having or at risk for a disorder characterized by unwanted c-MET expression, e.g., hepatocellular carcinoma.

In another preferred embodiment the iRNA agent silences the PKC gene, and thus can be used to treat a subject having or at risk for a disorder characterized by unwanted PKC expression, e.g., breast cancer.

In a preferred embodiment the iRNA agent silences the NFKB gene, and thus can be used to treat a subject having or at risk for a disorder characterized by unwanted NFKB expression, e.g., breast cancer.

In a preferred embodiment the iRNA agent silences the STAT3 gene, and thus can be used to treat a subject having or at risk for a disorder characterized by unwanted STAT3 expression, e.g., prostate cancer.

In another preferred embodiment the iRNA agent silences the survivin gene, and thus can be used to treat a subject having or at risk for a disorder characterized by unwanted survivin expression, e.g., cervical or pancreatic cancers.

In another preferred embodiment the iRNA agent silences the Her2/Neu gene, and thus can be used to treat a subject having or at risk for a disorder characterized by unwanted Her2/Neu expression, e.g., breast cancer.

In another preferred embodiment the iRNA agent silences the topoisomerase I gene, and thus can be used to treat a subject having or at risk for a disorder characterized by unwanted topoisomerase I expression, e.g., ovarian and colon cancers.

In a preferred embodiment the iRNA agent silences the topoisomerase II alpha gene, and thus can be used to treat a subject having or at risk for a disorder characterized by unwanted topoisomerase II expression, e.g., breast and colon cancers.

In a preferred embodiment the iRNA agent silences mutations in the p73 gene, and thus can be used to treat a subject having or at risk for a disorder characterized by unwanted p73 expression, e.g., colorectal adenocarcinoma.

In a preferred embodiment the iRNA agent silences mutations in the p21(WAF1/CIP1) gene, and thus can be used to treat a subject having or at risk for a disorder characterized by unwanted p21(WAF1/CIP1) expression, e.g., liver cancer.

In a preferred embodiment the iRNA agent silences mutations in the p27(KIP1) gene, and thus can be used to treat a subject having or at risk for a disorder characterized by unwanted p27(KIP1) expression, e.g., liver cancer.

In a preferred embodiment the iRNA agent silences mutations in the PPM1D gene, and thus can be used to treat a subject having or at risk for a disorder characterized by unwanted PPM1D expression, e.g., breast cancer.

In a preferred embodiment the iRNA agent silences mutations in the RAS gene, and thus can be used to treat a subject having or at risk for a disorder characterized by unwanted RAS expression, e.g., breast cancer.

In another preferred embodiment the iRNA agent silences mutations in the caveolin I gene, and thus can be used to treat a subject having or at risk for a disorder characterized by unwanted caveolin I expression, e.g., esophageal squamous cell carcinoma.

In another preferred embodiment the iRNA agent silences mutations in the MIB I gene, and thus can be used to treat a subject having or at risk for a disorder characterized by unwanted MIB I expression, e.g., male breast carcinoma (MBC).

In another preferred embodiment the iRNA agent silences mutations in the MTAI gene, and thus can be used to treat a subject having or at risk for a disorder characterized by unwanted MTAI expression, e.g., ovarian carcinoma.

In another preferred embodiment the iRNA agent silences mutations in the M68 gene, and thus can be used to treat a subject having or at risk for a disorder characterized by unwanted M68 expression, e.g., human adenocarcinomas of the esophagus, stomach, colon, and rectum.

In preferred embodiments the iRNA agent silences mutations in tumor suppressor genes, and thus can be used as a method to promote apoptotic activity in combination with chemotherapeutics.

In a preferred embodiment the iRNA agent silences mutations in the p53 tumor suppressor gene, and thus can be used to treat a subject having or at risk for a disorder characterized by unwanted p53 expression, e.g., gall bladder, pancreatic and lung cancers.

In a preferred embodiment the iRNA agent silences mutations in the p53 family member DN-p63, and thus can be used to treat a subject having or at risk for a disorder characterized by unwanted DN-p63 expression, e.g., squamous cell carcinoma In a preferred embodiment the iRNA agent silences mutations in the pRb tumor suppressor gene, and thus can be used to treat a subject having or at risk for a disorder characterized by unwanted pRb expression, e.g., oral squamous cell carcinoma In a preferred embodiment the iRNA agent silences mutations in the APC1 tumor suppressor gene, and thus can be used to treat a subject having or at risk for a disorder characterized by unwanted APC1 expression, e.g., colon cancer.

In a preferred embodiment the iRNA agent silences mutations in the BRCA1 tumor suppressor gene, and thus can be used to treat a subject having or at risk for a disorder characterized by unwanted BRCA1 expression, e.g., breast cancer.

In a preferred embodiment the iRNA agent silences mutations in the PTEN tumor suppressor gene, and thus can be used to treat a subject having or at risk for a disorder characterized by unwanted PTEN expression, e.g., hamartomas, gliomas, and prostate and endometrial cancers.

In a preferred embodiment the iRNA agent silences MLL fusion genes, e.g., MLL-AF9, and thus can be used to treat a subject having or at risk for a disorder characterized by unwanted MLL fusion gene expression, e.g., acute leukemias.

In another preferred embodiment the iRNA agent silences the BCR/ABL fusion gene, and thus can be used to treat a subject having or at risk for a disorder characterized by unwanted BCR/ABL fusion gene expression, e.g., acute and chronic leukemias.

In another preferred embodiment the iRNA agent silences the TEL/AML1 fusion gene, and thus can be used to treat a subject having or at risk for a disorder characterized by unwanted TEL/AML1 fusion gene expression, e.g., childhood acute leukemia.

In another preferred embodiment the iRNA agent silences the EWS/FLI1 fusion gene, and thus can be used to treat a subject having or at risk for a disorder characterized by unwanted EWS/FLI1 fusion gene expression, e.g., Ewing Sarcoma.

In another preferred embodiment the iRNA agent silences the TLS/FUS1 fusion gene, and thus can be used to treat a subject having or at risk for a disorder characterized by unwanted TLS/FUS1 fusion gene expression, e.g., Myxoid liposarcoma.

In another preferred embodiment the iRNA agent silences the PAX3/FKHR fusion gene, and thus can be used to treat a subject having or at risk for a disorder characterized by unwanted PAX3/FKHR fusion gene expression, e.g., Myxoid liposarcoma.

In another preferred embodiment the iRNA agent silences the AML1/ETO fusion gene, and thus can be used to treat a subject having or at risk for a disorder characterized by unwanted AML1/ETO fusion gene expression, e.g., acute leukemia.

In another aspect, the invention features, a method of treating a subject, e.g., a human, at risk for or afflicted with a disease or disorder that may benefit by angiogenesis inhibition e.g., cancer. The method includes:

providing an iRNA agent, e.g., an iRNA agent having a structure described herein, which iRNA agent is homologous to and can silence, e.g., by cleavage, a gene which mediates angiogenesis;

administering the iRNA agent to a subject, thereby treating the subject.

In a preferred embodiment the iRNA agent silences the alpha v-integrin gene, and thus can be used to treat a subject having or at risk for a disorder characterized by unwanted alpha V integrin, e.g., brain tumors or tumors of epithelial origin.

In a preferred embodiment the iRNA agent silences the Flt-1 receptor gene, and thus can be used to treat a subject having or at risk for a disorder characterized by unwanted Flt-1 receptors, eg. Cancer and rheumatoid arthritis.

In a preferred embodiment the iRNA agent silences the tubulin gene, and thus can be used to treat a subject having or at risk for a disorder characterized by unwanted tubulin, eg. Cancer and retinal neovascularization.

In a preferred embodiment the iRNA agent silences the tubulin gene, and thus can be used to treat a subject having or at risk for a disorder characterized by unwanted tubulin, eg. Cancer and retinal neovascularization.

In another aspect, the invention features a method of treating a subject infected with a virus or at risk for or afflicted with a disorder or disease associated with a viral infection. The method includes:

providing an iRNA agent, e.g., and iRNA agent having a structure described herein, which iRNA agent is homologous to and can silence, e.g., by cleavage, a viral gene of a cellular gene which mediates viral function, e.g., entry or growth;

administering the iRNA agent to a subject, preferably a human subject, thereby treating the subject.

Thus, the invention provides for a method of treating patients infected by the Human Papilloma Virus (HPV) or at risk for or afflicted with a disorder mediated by HPV, e.g, cervical cancer. HPV is linked to 95% of cervical carcinomas and thus an antiviral therapy is an attractive method to treat these cancers and other symptoms of viral infection.

In a preferred embodiment, the expression of a HPV gene is reduced. In another preferred embodiment, the HPV gene is one of the group of E2, E6, or E7.

In a preferred embodiment the expression of a human gene that is required for HPV replication is reduced.

The invention also includes a method of treating patients infected by the Human Immunodeficiency Virus (HIV) or at risk for or afflicted with a disorder mediated by HIV, e.g., Acquired Immune Deficiency Syndrome (AIDS).

In a preferred embodiment, the expression of a HIV gene is reduced. In another preferred embodiment, the HIV gene is CCR5, Gag, or Rev.

In a preferred embodiment the expression of a human gene that is required for HIV replication is reduced. In another preferred embodiment, the gene is CD4 or Tsg101.

The invention also includes a method for treating patients infected by the Hepatitis B Virus (HBV) or at risk for or afflicted with a disorder mediated by HBV, e.g., cirrhosis and heptocellular carcinoma.

In a preferred embodiment, the expression of a HBV gene is reduced. In another preferred embodiment, the targeted HBV gene encodes one of the group of the tail region of the HBV core protein, the pre-cregious (pre-c) region, or the cregious (c) region. In another preferred embodiment, a targeted HBV-RNA sequence is comprised of the poly(A) tail.

In preferred embodiment the expression of a human gene that is required for HBV replication is reduced.

The invention also provides for a method of treating patients infected by the Hepatitis A Virus (HAV), or at risk for or afflicted with a disorder mediated by HAV.

In a preferred embodiment the expression of a human gene that is required for HAV replication is reduced.

The present invention provides for a method of treating patients infected by the Hepatitis C Virus (HCV), or at risk for or afflicted with a disorder mediated by HCV, e.g., cirrhosis In a preferred embodiment, the expression of a HCV gene is reduced.

In another preferred embodiment the expression of a human gene that is required for HCV replication is reduced.

The present invention also provides for a method of treating patients infected by the any of the group of Hepatitis Viral strains comprising hepatitis D, E, F, G, or H, or patients at risk for or afflicted with a disorder mediated by any of these strains of hepatitis.

In a preferred embodiment, the expression of a Hepatitis, D, E, F, G, or H gene is reduced.

In another preferred embodiment the expression of a human gene that is required for hepatitis D, E, F, G or H replication is reduced.

Methods of the invention also provide for treating patients infected by the Respiratory Syncytial Virus (RSV) or at risk for or afflicted with a disorder mediated by RSV, e.g, lower respiratory tract infection in infants and childhood asthma, pneumonia and other complications, e.g., in the elderly.

In a preferred embodiment, the expression of a RSV gene is reduced. In another preferred embodiment, the targeted HBV gene encodes one of the group of genes N, L, or P.

In a preferred embodiment the expression of a human gene that is required for RSV replication is reduced.

Methods of the invention provide for treating patients infected by the Herpes Simplex Virus (HSV) or at risk for or afflicted with a disorder mediated by HSV, e.g, genital herpes and cold sores as well as life-threatening or sight-impairing disease mainly in immunocompromised patients.

In a preferred embodiment, the expression of a HSV gene is reduced. In another preferred embodiment, the targeted HSV gene encodes DNA polymerase or the helicase-primase.

In a preferred embodiment the expression of a human gene that is required for HSV replication is reduced.

The invention also provides a method for treating patients infected by the herpes Cytomegalovirus (CMV) or at risk for or afflicted with a disorder mediated by CMV, e.g., congenital virus infections and morbidity in immunocompromised patients.

In a preferred embodiment, the expression of a CMV gene is reduced.

In a preferred embodiment the expression of a human gene that is required for CMV replication is reduced.

Methods of the invention also provide for a method of treating patients infected by the herpes Epstein Barr Virus (EBV) or at risk for or afflicted with a disorder mediated by EBV, e.g., NK/T-cell lymphoma, non-Hodgkin lymphoma, and Hodgkin disease.

In a preferred embodiment, the expression of a EBV gene is reduced.

In a preferred embodiment the expression of a human gene that is required for EBV replication is reduced.

Methods of the invention also provide for treating patients infected by Kaposi's Sarcoma-associated Herpes Virus (KSHV), also called human herpesvirus 8, or patients at risk for or afflicted with a disorder mediated by KSHV, e.g., Kaposi's sarcoma, multicentric Castleman's disease and AIDS-associated primary effusion lymphoma.

In a preferred embodiment, the expression of a KSHV gene is reduced.

In a preferred embodiment the expression of a human gene that is required for KSHV replication is reduced.

The invention also includes a method for treating patients infected by the JC Virus (JCV) or a disease or disorder associated with this virus, e.g., progressive multifocal leukoencephalopathy (PML).

In a preferred embodiment, the expression of a JCV gene is reduced.

In preferred embodiment the expression of a human gene that is required for JCV replication is reduced.

Methods of the invention also provide for treating patients infected by the myxovirus or at risk for or afflicted with a disorder mediated by myxovirus, e.g., influenza.

In a preferred embodiment, the expression of a myxovirus gene is reduced.

In a preferred embodiment the expression of a human gene that is required for myxovirus replication is reduced.

Methods of the invention also provide for treating patients infected by the rhinovirus or at risk for of afflicted with a disorder mediated by rhinovirus, e.g., the common cold.

In a preferred embodiment, the expression of a rhinovirus gene is reduced.

In preferred embodiment the expression of a human gene that is required for rhinovirus replication is reduced.

Methods of the invention also provide for treating patients infected by the coronavirus or at risk for of afflicted with a disorder mediated by coronavirus, e.g., the common cold.

In a preferred embodiment, the expression of a coronavirus gene is reduced.

In preferred embodiment the expression of a human gene that is required for coronavirus replication is reduced.

Methods of the invention also provide for treating patients infected by the flavivirus West Nile or at risk for or afflicted with a disorder mediated by West Nile Virus.

In a preferred embodiment, the expression of a West Nile Virus gene is reduced. In another preferred embodiment, the West Nile Virus gene is one of the group comprising E, NS3, or NS5.

In a preferred embodiment the expression of a human gene that is required for West Nile Virus replication is reduced.

Methods of the invention also provide for treating patients infected by the St. Louis Encephalitis flavivirus, or at risk for or afflicted with a disease or disorder associated with this virus, e.g., viral haemorrhagic fever or neurological disease.

In a preferred embodiment, the expression of a St. Louis Encephalitis gene is reduced.

In a preferred embodiment the expression of a human gene that is required for St. Louis Encephalitis virus replication is reduced.

Methods of the invention also provide for treating patients infected by the Tick-borne encephalitis flavivirus, or at risk for or afflicted with a disorder mediated by Tick-borne encephalitis virus, e.g., viral haemorrhagic fever and neurological disease.

In a preferred embodiment, the expression of a Tick-borne encephalitis virus gene is reduced.

In a preferred embodiment the expression of a human gene that is required for Tick-borne encephalitis virus replication is reduced.

Methods of the invention also provide for methods of treating patients infected by the Murray Valley encephalitis flavivirus, which commonly results in viral haemorrhagic fever and neurological disease.

In a preferred embodiment, the expression of a Murray Valley encephalitis virus gene is reduced.

In a preferred embodiment the expression of a human gene that is required for Murray Valley encephalitis virus replication is reduced.

The invention also includes methods for treating patients infected by the dengue flavivirus, or a disease or disorder associated with this virus, e.g., dengue haemorrhagic fever.

In a preferred embodiment, the expression of a dengue virus gene is reduced.

In a preferred embodiment the expression of a human gene that is required for dengue virus replication is reduced.

Methods of the invention also provide for treating patients infected by the Simian Virus 40 (SV40) or at risk for or afflicted with a disorder mediated by SV40, e.g., tumorigenesis.

In a preferred embodiment, the expression of a SV40 gene is reduced.

In a preferred embodiment the expression of a human gene that is required for SV40 replication is reduced.

The invention also includes methods for treating patients infected by the Human T Cell Lymphotropic Virus (HTLV), or a disease or disorder associated with this virus, e.g., leukemia and myelopathy.

In a preferred embodiment, the expression of a HTLV gene is reduced. In another preferred embodiment the HTLV1 gene is the Tax transcriptional activator.

In a preferred embodiment the expression of a human gene that is required for HTLV replication is reduced.

Methods of the invention also provide for treating patients infected by the Moloney-Murine Leukemia Virus (Mo-MuLV) or at risk for or afflicted with a disorder mediated by Mo-MuLV, e.g., T-cell leukemia.

In a preferred embodiment, the expression of a Mo-MuLV gene is reduced.

In a preferred embodiment the expression of a human gene that is required for Mo-MuLV replication is reduced.

Methods of the invention also provide for treating patients infected by the encephalomyocarditis virus (EMCV) or at risk for or afflicted with a disorder mediated by EMCV, e.g. myocarditis. EMCV leads to myocarditis in mice and pigs and is capable of infecting human myocardial cells. This virus is therefore a concern for patients undergoing xenotransplantation.

In a preferred embodiment, the expression of a EMCV gene is reduced.

In a preferred embodiment the expression of a human gene that is required for EMCV replication is reduced.

The invention also includes a method for treating patients infected by the measles virus (MV) or at risk for or afflicted with a disorder mediated by MV, e.g. measles.

In a preferred embodiment, the expression of a MV gene is reduced.

In a preferred embodiment the expression of a human gene that is required for MV replication is reduced.

The invention also includes a method for treating patients infected by the Vericella zoster virus (VZV) or at risk for or afflicted with a disorder mediated by VZV, e.g. chicken pox or shingles (also called zoster).

In a preferred embodiment, the expression of a VZV gene is reduced.

In a preferred embodiment the expression of a human gene that is required for VZV replication is reduced.

The invention also includes a method for treating patients infected by an adenovirus or at risk for or afflicted with a disorder mediated by an adenovirus, e.g. respiratory tract infection.

In a preferred embodiment, the expression of an adenovirus gene is reduced.

In a preferred embodiment the expression of a human gene that is required for adenovirus replication is reduced.

The invention includes a method for treating patients infected by a yellow fever virus (YFV) or at risk for or afflicted with a disorder mediated by a YFV, e.g. respiratory tract infection.

In a preferred embodiment, the expression of a YFV gene is reduced. In another preferred embodiment, the preferred gene is one of a group that includes the E, NS2A, or NS3 genes.

In a preferred embodiment the expression of a human gene that is required for YFV replication is reduced.

Methods of the invention also provide for treating patients infected by the poliovirus or at risk for or afflicted with a disorder mediated by poliovirus, e.g., polio.

In a preferred embodiment, the expression of a poliovirus gene is reduced.

In a preferred embodiment the expression of a human gene that is required for poliovirus replication is reduced.

Methods of the invention also provide for treating patients infected by a poxvirus or at risk for or afflicted with a disorder mediated by a poxvirus, e.g., smallpox In a preferred embodiment, the expression of a poxvirus gene is reduced.

In a preferred embodiment the expression of a human gene that is required for poxvirus replication is reduced.

In another, aspect the invention features methods of treating a subject infected with a pathogen, e.g., a bacterial, amoebic, parasitic, or fungal pathogen. The method includes:

providing a iRNA agent, e.g., a siRNA having a structure described herein, where siRNA is homologous to and can silence, e.g., by cleavage of a pathogen gene;

administering the iRNA agent to a subject, preferably a human subject, thereby treating the subject.

The target gene can be one involved in growth, cell wall synthesis, protein synthesis, transcription, energy metabolism, e.g., the Krebs cycle, or toxin production.

Thus, the present invention provides for a method of treating patients infected by a *plasmodium* that causes malaria.

In a preferred embodiment, the expression of a *plasmodium* gene is reduced. In another preferred embodiment, the gene is apical membrane antigen 1 (AMA1).

In a preferred embodiment the expression of a human gene that is required for *plasmodium* replication is reduced.

The invention also includes methods for treating patients infected by the *Mycobacterium ulcerans*, or a disease or disorder associated with this pathogen, e.g. Buruli ulcers.

In a preferred embodiment, the expression of a *Mycobacterium ulcerans* gene is reduced.

In a preferred embodiment the expression of a human gene that is required for *Mycobacterium ulcerans* replication is reduced.

The invention also includes methods for treating patients infected by the *Mycobacterium tuberculosis*, or a disease or disorder associated with this pathogen, e.g. tuberculosis.

In a preferred embodiment, the expression of a *Mycobacterium tuberculosis* gene is reduced.

In a preferred embodiment the expression of a human gene that is required for *Mycobacterium tuberculosis* replication is reduced.

The invention also includes methods for treating patients infected by the *Mycobacterium leprae*, or a disease or disorder associated with this pathogen, e.g. leprosy.

In a preferred embodiment, the expression of a *Mycobacterium leprae* gene is reduced.

In a preferred embodiment the expression of a human gene that is required for *Mycobacterium leprae* replication is reduced.

The invention also includes methods for treating patients infected by the bacteria Staphylococcus aureus, or a disease or disorder associated with this pathogen, e.g. infections of the skin and muscous membranes.

In a preferred embodiment, the expression of a *Staphylococcus aureus* gene is reduced.

In a preferred embodiment the expression of a human gene that is required for *Staphylococcus aureus* replication is reduced.

The invention also includes methods for treating patients infected by the bacteria Streptococcus pneumoniae, or a disease or disorder associated with this pathogen, e.g. pneumonia or childhood lower respiratory tract infection.

In a preferred embodiment, the expression of a *Streptococcus pneumoniae* gene is reduced.

In a preferred embodiment the expression of a human gene that is required for *Streptococcus pneumoniae* replication is reduced.

The invention also includes methods for treating patients infected by the bacteria Streptococcus pyogenes, or a disease or disorder associated with this pathogen, e.g. Strep throat or Scarlet fever.

In a preferred embodiment, the expression of a *Streptococcus pyogenes* gene is reduced.

In a preferred embodiment the expression of a human gene that is required for *Streptococcus pyogenes* replication is reduced.

The invention also includes methods for treating patients infected by the bacteria Chlamydia pneumoniae, or a disease or disorder associated with this pathogen, e.g. pneumonia or childhood lower respiratory tract infection In a preferred embodiment, the expression of a *Chlamydia pneumoniae* gene is reduced.

In a preferred embodiment the expression of a human gene that is required for *Chlamydia pneumoniae* replication is reduced.

The invention also includes methods for treating patients infected by the bacteria *Mycoplasma pneumoniae*, or a disease or disorder associated with this pathogen, e.g. pneumonia or childhood lower respiratory tract infection In a preferred embodiment, the expression of a *Mycoplasma pneumoniae* gene is reduced.

In a preferred embodiment the expression of a human gene that is required for *Mycoplasma pneumoniae* replication is reduced.

In one aspect, the invention features, a method of treating a subject, e.g., a human, at risk for or afflicted with a disease or disorder characterized by an unwanted immune response, e.g., an inflammatory disease or disorder, or an autoimmune disease or disorder. The method includes:

providing an iRNA agent, e.g., an iRNA agent having a structure described herein, which iRNA agent is homologous to and can silence, e.g., by cleavage, a gene which mediates an unwanted immune response;

administering the iRNA agent to a subject, thereby treating the subject.

In a preferred embodiment the disease or disorder is an ischemia or reperfusion injury, e.g., ischemia or reperfusion injury associated with acute myocardial infarction, unstable angina, cardiopulmonary bypass, surgical intervention e.g., angioplasty, e.g., percutaneous transluminal coronary angioplasty, the response to a transplantated organ or tissue, e.g., transplanted cardiac or vascular tissue; or thrombolysis.

In a preferred embodiment the disease or disorder is restenosis, e.g., restenosis associated with surgical intervention e.g., angioplasty, e.g., percutaneous transluminal coronary angioplasty.

In a preferred embodiment the disease or disorder is Inflammatory Bowel Disease, e.g., Crohn Disease or Ulcerative Colitis.

In a preferred embodiment the disease or disorder is inflammation associated with an infection or injury.

In a preferred embodiment the disease or disorder is asthma, lupus, multiple sclerosis, diabetes, e.g., type II diabetes, arthritis, e.g., rheumatoid or psoriatic.

In particularly preferred embodiments the iRNA agent silences an integrin or co-ligand thereof, e.g., VLA4, VCAM, ICAM.

In particularly preferred embodiments the iRNA agent silences a selectin or co-ligand thereof, e.g., P-selectin, E-selectin (ELAM), I-selectin, P-selectin glycoprotein-1 (PSGL-1).

In particularly preferred embodiments the iRNA agent silences a component of the complement system, e.g., C3, C5, C3aR, C5aR, C3 convertase, C5 convertase.

In particularly preferred embodiments the iRNA agent silences a chemokine or receptor thereof, e.g., TNFI, TNFJ, IL-1I, IL-1J, IL-2, IL-2R, IL-4, IL-4R, IL-5, IL-6, IL-8, TNFR1, TNFRII, IgE, SCYA11, CCR3.

In other embodiments the iRNA agent silences GCSF, Gro1, Gro2, Gro3, PF4, MIG, Pro-Platelet Basic Protein (PPBP), MIP-1I, MIP-1J, RANTES, MCP-1, MCP-2, MCP-3, CMBKR1, CMBKR2, CMBKR3, CMBKR5, AIF-1, I-309.

In one aspect, the invention features, a method of treating a subject, e.g., a human, at risk for or afflicted with acute pain or chronic pain. The method includes:

providing an iRNA agent, which iRNA is homologous to and can silence, e.g., by cleavage, a gene which mediates the processing of pain;

administering the iRNA to a subject, thereby treating the subject.

In particularly preferred embodiments the iRNA agent silences a component of an ion channel.

In particularly preferred embodiments the iRNA agent silences a neurotransmitter receptor or ligand.

In one aspect, the invention features, a method of treating a subject, e.g., a human, at risk for or afflicted with a neurological disease or disorder. The method includes:

providing an iRNA agent which iRNA is homologous to and can silence, e.g., by cleavage, a gene which mediates a neurological disease or disorder;

administering the to a subject, thereby treating the subject.

In a preferred embodiment the disease or disorder is Alzheimer Disease or Parkinson Disease.

In particularly preferred embodiments the iRNA agent silences an amyloid-family gene, e.g., APP; a presenilin gene, e.g., PSEN1 and PSEN2, or I-synuclein.

In a preferred embodiment the disease or disorder is a neurodegenerative trinucleotide repeat disorder, e.g., Huntington disease, dentatorubral pallidoluysian atrophy or a spinocerebellar ataxia, e.g., SCA1, SCA2, SCA3 (Machado-Joseph disease), SCA7 or SCA8. In particularly preferred embodiments the iRNA agent silences HD, DRPLA, SCA1, SCA2, MJD1, CACNL1A4, SCA7, SCA8.

The loss of heterozygosity (LOH) can result in hemizygosity for sequence, e.g., genes, in the area of LOH. This can result in a significant genetic difference between normal and disease-state cells, e.g., cancer cells, and provides a useful difference between normal and disease-state cells, e.g., cancer cells. This difference can arise because a gene or other sequence is heterozygous in euploid cells but is hemizygous in cells having LOH. The regions of LOH will often include a gene, the loss of which promotes unwanted proliferation, e.g., a tumor suppressor gene, and other sequences including, e.g., other genes, in some cases a gene which is essential for normal function, e.g., growth. Methods of the invention rely, in part, on the specific cleavage or silencing of one allele of an essential gene with an iRNA agent of the invention. The iRNA agent is selected such that it targets the single allele of the essential gene found in the cells having LOH but does not silence the other allele, which is present in cells which do not show LOH. In essence, it discriminates between the two alleles, preferentially silencing the selected allele. In essence polymorphisms, e.g., SNPs of essential genes that are affected by LOH, are used as a target for a disorder characterized by cells having LOH, e.g., cancer cells having LOH.

E.g., one of ordinary skill in the art can identify essential genes which are in proximity to tumor suppressor genes, and which are within a LOH region which includes the tumor suppressor gene. The gene encoding the large subunit of human RNA polymerase II, POLR2A, a gene located in close proximity to the tumor suppressor gene p53, is such a gene. It frequently occurs within a region of LOH in cancer cells. Other genes that occur within LOH regions and are lost in many cancer cell types include the group comprising replication protein A 70-kDa subunit, replication protein A 32-kD, ribonucleotide reductase, thymidylate synthase, TATA associated factor 2H, ribosomal protein S14, eukaryotic initiation factor 5A, alanyl tRNA synthetase, cysteinyl tRNA synthetase, NaK ATPase, alpha-1 subunit, and transferrin receptor.

Accordingly, the invention features, a method of treating a disorder characterized by LOH, e.g., cancer. The method includes:

optionally, determining the genotype of the allele of a gene in the region of LOH and preferably determining the genotype of both alleles of the gene in a normal cell;

providing an iRNA agent which preferentially cleaves or silences the allele found in the LOH cells;

administering the iRNA to the subject, thereby treating the disorder.

The invention also includes a iRNA agent disclosed herein, e.g, an iRNA agent which can preferentially silence, e.g., cleave, one allele of a polymorphic gene In another aspect, the invention provides a method of cleaving or silencing more than one gene with an iRNA agent. In these embodiments the iRNA agent is selected so that it has sufficient homology to a sequence found in more than one gene. For example, the sequence AAGCTGGCCCTGGA-CATGGAGAT (SEQ ID NO:6736) is conserved between mouse lamin B1, lamin B2, keratin complex 2-gene 1 and lamin A/C. Thus an iRNA agent targeted to this sequence would effectively silence the entire collection of genes.

The invention also includes an iRNA agent disclosed herein, which can silence more than one gene.

Route of Delivery

For ease of exposition the formulations, compositions and methods in this section are discussed largely with regard to unmodified iRNA agents. It should be understood, however, that these formulations, compositions and methods can be practiced with other iRNA agents, e.g., modified iRNA agents, and such practice is within the invention. A composition that includes a iRNA can be delivered to a subject by a variety of routes. Exemplary routes include: intravenous, topical, rectal, anal, vaginal, nasal, pulmonary, ocular.

The iRNA molecules of the invention can be incorporated into pharmaceutical compositions suitable for administration. Such compositions typically include one or more species of iRNA and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the iRNA in aerosol form. The vascular endothelial cells could be targeted by coating a balloon catheter with the iRNA and mechanically introducing the DNA.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Compositions for intrathecal or intraventricular administration may include sterile aqueous solutions which may also contain buffers, diluents and other suitable additives.

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes should be controlled to render the preparation isotonic.

For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers.

Topical Delivery

For ease of exposition the formulations, compositions and methods in this section are discussed largely with regard to unmodified iRNA agents. It should be understood, however, that these formulations, compositions and methods can be practiced with other iRNA agents, e.g., modified iRNA agents, and such practice is within the invention. In a preferred embodiment, an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) is delivered to a subject via topical administration. "Topical administration" refers to the delivery to a subject by contacting the formulation directly to a surface of the subject. The most common form of topical delivery is to the skin, but a composition disclosed herein can also be directly applied to other surfaces of the body, e.g., to the eye, a mucous membrane, to surfaces of a body cavity or to an internal surface. As mentioned above, the most common topical delivery is to the skin. The term encompasses several routes of administration including, but not limited to, topical and transdermal. These modes of administration typically include penetration of the skin's permeability barrier and efficient delivery to the target tissue or stratum. Topical administration can be used as a means to penetrate the epidermis and dermis and ultimately achieve systemic delivery of the composition. Topical administration can also be used as a means to selectively deliver oligonucleotides to the epidermis or dermis of a subject, or to specific strata thereof, or to an underlying tissue.

The term "skin," as used herein, refers to the epidermis and/or dermis of an animal. Mammalian skin consists of two major, distinct layers. The outer layer of the skin is called the epidermis. The epidermis is comprised of the stratum corneum, the stratum granulosum, the stratum spinosum, and the stratum basale, with the stratum corneum being at the surface of the skin and the stratum basale being the deepest portion of the epidermis. The epidermis is between 50 µm and 0.2 mm thick, depending on its location on the body.

Beneath the epidermis is the dermis, which is significantly thicker than the epidermis. The dermis is primarily composed of collagen in the form of fibrous bundles. The collagenous bundles provide support for, inter alia, blood vessels, lymph capillaries, glands, nerve endings and immunologically active cells.

One of the major functions of the skin as an organ is to regulate the entry of substances into the body. The principal permeability barrier of the skin is provided by the stratum corneum, which is formed from many layers of cells in various states of differentiation. The spaces between cells in the stratum corneum is filled with different lipids arranged in lattice-like formations that provide seals to further enhance the skins permeability barrier.

The permeability barrier provided by the skin is such that it is largely impermeable to molecules having molecular weight greater than about 750 Da. For larger molecules to cross the skin's permeability barrier, mechanisms other than normal osmosis must be used.

Several factors determine the permeability of the skin to administered agents. These factors include the characteristics of the treated skin, the characteristics of the delivery agent, interactions between both the drug and delivery agent and the drug and skin, the dosage of the drug applied, the form of treatment, and the post treatment regimen. To selectively target the epidermis and dermis, it is sometimes possible to formulate a composition that comprises one or more penetration enhancers that will enable penetration of the drug to a preselected stratum.

Transdermal delivery is a valuable route for the administration of lipid soluble therapeutics. The dermis is more permeable than the epidermis and therefore absorption is much more rapid through abraded, burned or denuded skin. Inflammation and other physiologic conditions that increase blood flow to the skin also enhance transdermal adsorption. Absorption via this route may be enhanced by the use of an oily vehicle (inunction) or through the use of one or more penetration enhancers. Other effective ways to deliver a composition disclosed herein via the transdermal route include hydration of the skin and the use of controlled release topical patches. The transdermal route provides a potentially effective means to deliver a composition disclosed herein for systemic and/or local therapy.

In addition, iontophoresis (transfer of ionic solutes through biological membranes under the influence of an electric field) (Lee et al., Critical Reviews in Therapeutic Drug Carrier Systems, 1991, p. 163), phonophoresis or sonophoresis (use of ultrasound to enhance the absorption of various therapeutic agents across biological membranes, notably the skin and the cornea) (Lee et al., Critical Reviews in Therapeutic Drug Carrier Systems, 1991, p. 166), and optimization of vehicle characteristics relative to dose position and retention at the site of administration (Lee et al., Critical Reviews in Therapeutic Drug Carrier Systems, 1991, p. 168) may be useful methods for enhancing the transport of topically applied compositions across skin and mucosal sites.

The compositions and methods provided may also be used to examine the function of various proteins and genes in vitro in cultured or preserved dermal tissues and in animals. The invention can be thus applied to examine the function of any gene. The methods of the invention can also be used therapeutically or prophylactically. For example, for the treatment of animals that are known or suspected to suffer from diseases such as psoriasis, lichen planus, toxic epidermal necrolysis, ertythema multiforme, basal cell carcinoma, squamous cell carcinoma, malignant melanoma, Paget's disease, Kaposi's sarcoma, pulmonary fibrosis, Lyme disease and viral, fungal and bacterial infections of the skin.

Pulmonary Delivery

For ease of exposition the formulations, compositions and methods in this section are discussed largely with regard to unmodified iRNA agents. It should be understood, however, that these formulations, compositions and methods can be practiced with other iRNA agents, e.g., modified iRNA agents, and such practice is within the invention. A composition that includes an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) can be administered to a subject by pulmonary delivery. Pulmonary delivery compositions can be delivered by inhalation by the patient of a dispersion so that the composition, preferably iRNA, within the dispersion can reach the lung where it can be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self contained. Dry powder dispersion devices, for example, deliver drugs that may be readily formulated as dry powders. A iRNA composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

The term "powder" means a composition that consists of finely dispersed solid particles that are free flowing and capable of being readily dispersed in an inhalation device and subsequently inhaled by a subject so that the particles reach the lungs to permit penetration into the alveoli. Thus, the powder is said to be "respirable." Preferably the average particle size is less than about 10 µm in diameter preferably with a relatively uniform spheroidal shape distribution. More preferably the diameter is less than about 7.5 µm and most preferably less than about 5.0 µm. Usually the particle size distribution is between about 0.1 µm and about 5 µm in diameter, particularly about 0.3 µm to about 5 µm.

The term "dry" means that the composition has a moisture content below about 10% by weight (% w) water, usually below about 5% w and preferably less it than about 3% w. A dry composition can be such that the particles are readily dispersible in an inhalation device to form an aerosol.

The term "therapeutically effective amount" is the amount present in the composition that is needed to provide the desired level of drug in the subject to be treated to give the anticipated physiological response.

The term "physiologically effective amount" is that amount delivered to a subject to give the desired palliative or curative effect.

The term "pharmaceutically acceptable carrier" means that the carrier can be taken into the lungs with no significant adverse toxicological effects on the lungs.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Bulking agents that are particularly valuable include compatible carbohydrates, polypeptides, amino acids or combinations thereof. Suitable carbohydrates include monosaccharides such as galactose, D-mannose, sorbose, and the like; disaccharides, such as lactose, trehalose, and the like; cyclodextrins, such as 2-hydroxypropyl-.beta.-cyclodextrin; and polysaccharides, such as raffinose, maltodextrins, dextrans, and the like; alditols, such as mannitol, xylitol, and the like. A preferred group of carbohydrates includes lactose, threhalose, raffinose maltodextrins, and mannitol. Suitable polypeptides include aspartame. Amino acids include alanine and glycine, with glycine being preferred.

Additives, which are minor components of the composition of this invention, may be included for conformational stability during spray drying and for improving dispersibility of the powder. These additives include hydrophobic amino acids such as tryptophan, tyrosine, leucine, phenylalanine, and the like.

Suitable pH adjusters or buffers include organic salts prepared from organic acids and bases, such as sodium citrate, sodium ascorbate, and the like; sodium citrate is preferred.

Pulmonary administration of a micellar iRNA formulation may be achieved through metered dose spray devices with propellants such as tetrafluoroethane, heptafluoroethane, dimethylfluoropropane, tetrafluoropropane, butane, isobutane, dimethyl ether and other non-CFC and CFC propellants.

Oral or Nasal Delivery

For ease of exposition the formulations, compositions and methods in this section are discussed largely with regard to unmodified iRNA agents. It should be understood, however, that these formulations, compositions and methods can be practiced with other iRNA agents, e.g., modified iRNA agents, and such practice is within the invention. Both the oral and nasal membranes offer advantages over other routes of administration. For example, drugs administered through these membranes have a rapid onset of action, provide therapeutic plasma levels, avoid first pass effect of hepatic metabolism, and avoid exposure of the drug to the hostile gastrointestinal (GI) environment. Additional advantages include easy access to the membrane sites so that the drug can be applied, localized and removed easily.

In oral delivery, compositions can be targeted to a surface of the oral cavity, e.g., to sublingual mucosa which includes the membrane of ventral surface of the tongue and the floor of the mouth or the buccal mucosa which constitutes the lining of the cheek. The sublingual mucosa is relatively permeable thus giving rapid absorption and acceptable bioavailability of many drugs. Further, the sublingual mucosa is convenient, acceptable and easily accessible.

The ability of molecules to permeate through the oral mucosa appears to be related to molecular size, lipid solubility and peptide protein ionization. Small molecules, less than 1000 daltons appear to cross mucosa rapidly. As molecular size increases, the permeability decreases rapidly. Lipid soluble compounds are more permeable than non-lipid soluble molecules. Maximum absorption occurs when molecules are unionized or neutral in electrical charges. Therefore charged molecules present the biggest challenges to absorption through the oral mucosae.

A pharmaceutical composition of iRNA may also be administered to the buccal cavity of a human being by spraying into the cavity, without inhalation, from a metered dose spray dispenser, a mixed micellar pharmaceutical formulation as described above and a propellant. In one embodiment, the dispenser is first shaken prior to spraying the pharmaceutical formulation and propellant into the buccal cavity.

Devices

For ease of exposition the devices, formulations, compositions and methods in this section are discussed largely with regard to unmodified iRNA agents. It should be understood, however, that these devices, formulations, compositions and methods can be practiced with other iRNA agents, e.g., modified iRNA agents, and such practice is within the invention. An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) can be disposed on or in a device, e.g., a device which implanted or otherwise placed in a subject. Exemplary devices include devices which are introduced into the vasculature, e.g., devices inserted into the lumen of a vascular tissue, or which devices themselves form a part of the vasculature, including stents, catheters, heart valves, and other vascular devices. These devices, e.g., catheters or stents, can be placed in the vasculature of the lung, heart, or leg.

Other devices include non-vascular devices, e.g., devices implanted in the peritoneum, or in organ or glandular tissue, e.g., artificial organs. The device can release a therapeutic substance in addition to a iRNA, e.g., a device can release insulin.

Other devices include artificial joints, e.g., hip joints, and other orthopedic implants.

In one embodiment, unit doses or measured doses of a composition that includes iRNA are dispensed by an implanted device. The device can include a sensor that monitors a parameter within a subject. For example, the device can include pump, e.g., and, optionally, associated electronics.

Tissue, e.g., cells or organs can be treated with An iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), ex vivo and then administered or implanted in a subject.

The tissue can be autologous, allogeneic, or xenogeneic tissue. E.g., tissue can be treated to reduce graft v. host disease. In other embodiments, the tissue is allogeneic and the tissue is treated to treat a disorder characterized by unwanted gene expression in that tissue. E.g., tissue, e.g., hematopoietic cells, e.g., bone marrow hematopoietic cells, can be treated to inhibit unwanted cell proliferation.

Introduction of treated tissue, whether autologous or transplant, can be combined with other therapies.

In some implementations, the iRNA treated cells are insulated from other cells, e.g., by a semi-permeable porous barrier that prevents the cells from leaving the implant, but enables molecules from the body to reach the cells and molecules produced by the cells to enter the body. In one embodiment, the porous barrier is formed from alginate.

In one embodiment, a contraceptive device is coated with or contains an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof). Exemplary devices include condoms, diaphragms, IUD (implantable uterine devices, sponges, vaginal sheaths, and birth control devices. In one embodiment, the iRNA is chosen to inactive sperm or egg. In another embodiment, the iRNA is chosen to be complementary to a viral or pathogen RNA, e.g., an RNA of an STD. In some instances, the iRNA composition can include a spermicide.

Dosage

In one aspect, the invention features a method of administering an iRNA agent, e.g., a double-stranded iRNA agent, or sRNA agent, to a subject (e.g., a human subject). The method includes administering a unit dose of the iRNA agent, e.g., a sRNA agent, e.g., double stranded sRNA agent that (a) the double-stranded part is 19-25 nucleotides (nt) long, preferably 21-23 nt, (b) is complementary to a target RNA (e.g., an endogenous or pathogen target RNA), and, optionally, (c) includes at least one 3' overhang 1-5 nucleotide long. In one embodiment, the unit dose is less than 1.4 mg per kg of bodyweight, or less than 10, 5, 2, 1, 0.5, 0.1, 0.05, 0.01, 0.005, 0.001, 0.0005, 0.0001, 0.00005 or 0.00001 mg per kg of bodyweight, and less than 200 nmole of RNA agent (e.g. about $4.4\times10^{16}$ copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmole of RNA agent per kg of bodyweight.

The defined amount can be an amount effective to treat or prevent a disease or disorder, e.g., a disease or disorder associated with the target RNA. The unit dose, for example, can be administered by injection (e.g., intravenous or intramuscular), an inhaled dose, or a topical application. Particularly preferred dosages are less than 2, 1, or 0.1 mg/kg of body weight.

In a preferred embodiment, the unit dose is administered less frequently than once a day, e.g., less than every 2, 4, 8 or 30 days. In another embodiment, the unit dose is not administered with a frequency (e.g., not a regular frequency). For example, the unit dose may be administered a single time.

In one embodiment, the effective dose is administered with other traditional therapeutic modalities. In one embodiment, the subject has a viral infection and the modality is an antiviral agent other than an iRNA agent, e.g., other than a double-stranded iRNA agent, or sRNA agent. In another embodiment, the subject has atherosclerosis and the effective dose of an iRNA agent, e.g., a double-stranded iRNA agent, or sRNA agent, is administered in combination with, e.g., after surgical intervention, e.g., angioplasty.

In one embodiment, a subject is administered an initial dose and one or more maintenance doses of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof). The maintenance dose or doses are generally lower than the initial dose, e.g., one-half less of the initial dose. A maintenance regimen can include treating the subject with a dose or doses ranging from 0.01 µg to 1.4 mg/kg of body weight per day, e.g., 10, 1, 0.1, 0.01, 0.001, or 0.00001 mg per kg of bodyweight per day. The maintenance doses are preferably administered no more than once every 5, 10, or 30 days. Further, the treatment regimen may last for a period of time which will vary depending upon the nature of the particular disease, its severity and the overall condition of the patient. In preferred embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In one embodiment, the iRNA agent pharmaceutical composition includes a plurality of iRNA agent species. In another embodiment, the iRNA agent species has sequences that are non-overlapping and non-adjacent to another species with respect to a naturally occurring target sequence. In another embodiment, the plurality of iRNA agent species is specific for different naturally occurring target genes. In another embodiment, the iRNA agent is allele specific.

In some cases, a patient is treated with a iRNA agent in conjunction with other therapeutic modalities. For example, a patient being treated for a viral disease, e.g. an HIV associated disease (e.g., AIDS), may be administered a iRNA agent specific for a target gene essential to the virus in conjunction with a known antiviral agent (e.g., a protease inhibitor or reverse transcriptase inhibitor). In another example, a patient being treated for cancer may be administered a iRNA agent specific for a target essential for tumor cell proliferation in conjunction with a chemotherapy.

Following successful treatment, it may be desirable to have the patient undergo maintenance therapy to prevent the recurrence of the disease state, wherein the compound of the invention is administered in maintenance doses, ranging from 0.01 µg to 100 g per kg of body weight (see U.S. Pat. No. 6,107, 094).

The concentration of the iRNA agent composition is an amount sufficient to be effective in treating or preventing a disorder or to regulate a physiological condition in humans. The concentration or amount of iRNA agent administered will depend on the parameters determined for the agent and the method of administration, e.g. nasal, buccal, pulmonary. For example, nasal formulations tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. Moreover, treatment of a subject with a therapeutically effective amount of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) can include a single treatment or, preferably, can include a series of treatments. It will also be appreciated that the effective dosage of a iRNA agent such as a sRNA agent used for treatment may increase or decrease over the course of a particular treatment. Changes in dosage may result and become apparent from the results of diagnostic assays as described herein. For example, the subject can be monitored after administering a iRNA agent composition. Based on information from the monitoring, an additional amount of the iRNA agent composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models. In some embodiments, the animal models include transgenic animals that express a human gene, e.g. a gene that produces a target RNA. The transgenic animal can be deficient for the corresponding endogenous RNA. In another embodiment, the composition for testing includes a iRNA agent that is complementary, at least in an internal region, to a sequence that is conserved between the target RNA in the animal model and the target RNA in a human.

The inventors have discovered that iRNA agents described herein can be administered to mammals, particularly large mammals such as nonhuman primates or humans in a number of ways.

In one embodiment, the administration of the iRNA agent, e.g., a double-stranded iRNA agent, or sRNA agent, composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The medication can be provided in measured doses or in a dispenser which delivers a metered dose. Selected modes of delivery are discussed in more detail below.

The invention provides methods, compositions, and kits, for rectal administration or delivery of iRNA agents described herein.

Accordingly, an iRNA agent, e.g., a double-stranded iRNA agent, or sRNA agent, (e.g., a precursor, e.g., a larger iRNA agent which can be processed into a sRNA agent, or a DNA which encodes a an iRNA agent, e.g., a double-stranded iRNA agent, or sRNA agent, or precursor thereof) described herein, e.g., a therapeutically effective amount of a iRNA agent described herein, e.g., a iRNA agent having a double stranded region of less than 40, and preferably less than 30 nucleotides and having one or two 1-3 nucleotide single strand 3' overhangs can be administered rectally, e.g., introduced through the rectum into the lower or upper colon. This approach is particularly useful in the treatment of, inflammatory disorders, disorders characterized by unwanted cell proliferation, e.g., polyps, or colon cancer.

The medication can be delivered to a site in the colon by introducing a dispensing device, e.g., a flexible, camera-guided device similar to that used for inspection of the colon or removal of polyps, which includes means for delivery of the medication.

The rectal administration of the iRNA agent is by means of an enema. The iRNA agent of the enema can be dissolved in a saline or buffered solution. The rectal administration can also by means of a suppository, which can include other ingredients, e.g., an excipient, e.g., cocoa butter or hydropropylmethylcellulose.

Any of the iRNA agents described herein can be administered orally, e.g., in the form of tablets, capsules, gel capsules, lozenges, troches or liquid syrups. Further, the composition can be applied topically to a surface of the oral cavity.

Any of the iRNA agents described herein can be administered buccally. For example, the medication can be sprayed into the buccal cavity or applied directly, e.g., in a liquid, solid, or gel form to a surface in the buccal cavity. This administration is particularly desirable for the treatment of inflammations of the buccal cavity, e.g., the gums or tongue, e.g., in one embodiment, the buccal administration is by spraying into the cavity, e.g., without inhalation, from a dispenser, e.g., a metered dose spray dispenser that dispenses the pharmaceutical composition and a propellant.

Any of the iRNA agents described herein can be administered to ocular tissue. For example, the medications can be applied to the surface of the eye or nearby tissue, e.g., the inside of the eyelid. They can be applied topically, e.g., by spraying, in drops, as an eyewash, or an ointment. Administration can be provided by the subject or by another person, e.g., a health care provider. The medication can be provided in measured doses or in a dispenser which delivers a metered dose. The medication can also be administered to the interior of the eye, and can be introduced by a needle or other delivery device which can introduce it to a selected area or structure. Ocular treatment is particularly desirable for treating inflammation of the eye or nearby tissue.

Any of the iRNA agents described herein can be administered directly to the skin. For example, the medication can be applied topically or delivered in a layer of the skin, e.g., by the use of a microneedle or a battery of microneedles which penetrate into the skin, but preferably not into the underlying muscle tissue. Administration of the iRNA agent composition can be topical. Topical applications can, for example, deliver the composition to the dermis or epidermis of a subject. Topical administration can be in the form of transdermal patches, ointments, lotions, creams, gels, drops, suppositories, sprays, liquids or powders. A composition for topical administration can be formulated as a liposome, micelle, emulsion, or other lipophilic molecular assembly. The transdermal administration can be applied with at least one penetration enhancer, such as iontophoresis, phonophoresis, and sonophoresis.

Any of the iRNA agents described herein can be administered to the pulmonary system. Pulmonary administration can be achieved by inhalation or by the introduction of a delivery device into the pulmonary system, e.g., by introducing a delivery device which can dispense the medication. A preferred method of pulmonary delivery is by inhalation. The medication can be provided in a dispenser which delivers the medication, e.g., wet or dry, in a form sufficiently small such that it can be inhaled. The device can deliver a metered dose of medication. The subject, or another person, can administer the medication.

Pulmonary delivery is effective not only for disorders which directly affect pulmonary tissue, but also for disorders which affect other tissue.

iRNA agents can be formulated as a liquid or nonliquid, e.g., a powder, crystal, or aerosol for pulmonary delivery.

Any of the iRNA agents described herein can be administered nasally. Nasal administration can be achieved by introduction of a delivery device into the nose, e.g., by introducing a delivery device which can dispense the medication. Methods of nasal delivery include spray, aerosol, liquid, e.g., by drops, or by topical administration to a surface of the nasal cavity. The medication can be provided in a dispenser with delivery of the medication, e.g., wet or dry, in a form sufficiently small such that it can be inhaled. The device can deliver a metered dose of medication. The subject, or another person, can administer the medication.

Nasal delivery is effective not only for disorders which directly affect nasal tissue, but also for disorders which affect other tissue iRNA agents can be formulated as a liquid or nonliquid, e.g., a powder, crystal, or for nasal delivery.

An iRNA agent can be packaged in a viral natural capsid or in a chemically or enzymatically produced artificial capsid or structure derived therefrom.

The dosage of a pharmaceutical composition including a iRNA agent can be administered in order to alleviate the symptoms of a disease state, e.g., cancer or a cardiovascular disease. A subject can be treated with the pharmaceutical composition by any of the methods mentioned above.

Gene expression in a subject can be modulated by administering a pharmaceutical composition including an iRNA agent.

A subject can be treated by administering a defined amount of an iRNA agent, e.g., a double-stranded iRNA agent, or sRNA agent, (e.g., a precursor, e.g., a larger iRNA agent which can be processed into a sRNA agent) composition that is in a powdered form, e.g., a collection of microparticles, such as crystalline particles. The composition can include a plurality of iRNA agents, e.g., specific for one or more different endogenous target RNAs. The method can include other features described herein.

A subject can be treated by administering a defined amount of an iRNA agent composition that is prepared by a method that includes spray-drying, i.e. atomizing a liquid solution, emulsion, or suspension, immediately exposing the droplets to a drying gas, and collecting the resulting porous powder particles. The composition can include a plurality of iRNA agents, e.g., specific for one or more different endogenous target RNAs. The method can include other features described herein.

The iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), can be provided in a powdered, crystallized or other finely divided form, with or without a carrier, e.g., a micro- or nano-particle suitable for inhalation or other pulmonary delivery. This can include providing an aerosol preparation, e.g., an aerosolized spray-dried composition. The aerosol composition can be provided in and/or dispensed by a metered dose delivery device.

The subject can be treated for a condition treatable by inhalation, e.g., by aerosolizing a spray-dried iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) composition and inhaling the aerosolized composition. The iRNA agent can be an sRNA. The composition can include a plurality of iRNA agents, e.g., specific for one or more different endogenous target RNAs. The method can include other features described herein.

A subject can be treated by, for example, administering a composition including an effective/defined amount of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), wherein the composition is prepared by a method that includes spray-drying, lyophilization, vacuum drying, evaporation, fluid bed drying, or a combination of these techniques In another aspect, the invention features a method that includes: evaluating a parameter related to the abundance of a transcript in a cell of a subject; comparing the evaluated parameter to a reference value; and if the evaluated parameter has a preselected relationship to the reference value (e.g., it is greater), administering a iRNA agent (or a precursor, e.g., a larger iRNA agent which can be processed into a sRNA agent, or a DNA which encodes a iRNA agent or precursor thereof) to the subject. In one embodiment, the iRNA agent includes a sequence that is complementary to the evaluated transcript. For example, the parameter can be a direct measure of transcript levels, a measure of a protein level, a disease or disorder symptom or characterization (e.g., rate of cell proliferation and/or tumor mass, viral load,)

In another aspect, the invention features a method that includes: administering a first amount of a composition that comprises an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) to a subject, wherein the iRNA agent includes a strand substantially complementary to a target nucleic acid; evaluating an activity associated with a protein encoded by the target nucleic acid; wherein the evaluation is used to determine if a second amount should be administered. In a preferred embodiment the method includes administering a second amount of the composition, wherein the timing of administration or dosage of the second amount is a function of the evaluating. The method can include other features described herein.

In another aspect, the invention features a method of administering a source of a double-stranded iRNA agent (ds iRNA agent) to a subject. The method includes administering or implanting a source of a ds iRNA agent, e.g., a sRNA agent, that (a) includes a double-stranded region that is 19-25 nucleotides long, preferably 21-23 nucleotides, (b) is complementary to a target RNA (e.g., an endogenous RNA or a pathogen RNA), and, optionally, (c) includes at least one 3' overhang 1-5 nt long. In one embodiment, the source releases ds iRNA agent over time, e.g. the source is a controlled or a slow release source, e.g., a microparticle that gradually releases the ds iRNA agent. In another embodiment, the source is a pump, e.g., a pump that includes a sensor or a pump that can release one or more unit doses.

In one aspect, the invention features a pharmaceutical composition that includes an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) including a nucleotide sequence complementary to a target RNA, e.g., substantially and/or exactly complementary. The target RNA can be a transcript of an endogenous human gene. In one embodiment, the iRNA agent (a) is 19-25 nucleotides long, preferably 21-23 nucleotides, (b) is complementary to an endogenous target RNA, and, optionally, (c) includes at least one 3' overhang 1-5 nt long. In one embodiment, the pharmaceutical composition can be an emulsion, microemulsion, cream, jelly, or liposome.

In one example the pharmaceutical composition includes an iRNA agent mixed with a topical delivery agent. The topical delivery agent can be a plurality of microscopic vesicles. The microscopic vesicles can be liposomes. In a preferred embodiment the liposomes are cationic liposomes.

In another aspect, the pharmaceutical composition includes an iRNA agent, e.g., a double-stranded iRNA agent, or sRNA agent (e.g., a precursor, e.g., a larger iRNA agent which can be processed into a sRNA agent, or a DNA which encodes an iRNA agent, e.g., a double-stranded iRNA agent, or sRNA agent, or precursor thereof) admixed with a topical penetration enhancer. In one embodiment, the topical penetration enhancer is a fatty acid. The fatty acid can be arachidonic acid, oleic acid, lauric acid, caprylic acid, capric acid, myristic acid, palmitic acid, stearic acid, linoleic acid, linolenic acid, dicaprate, tricaprate, monolein, dilaurin, glyceryl 1-monocaprate, 1-dodecylazacycloheptan-2-one, an acylcarnitine, an acylcholine, or a $C_{1-10}$ alkyl ester, monoglyceride, diglyceride or pharmaceutically acceptable salt thereof.

In another embodiment, the topical penetration enhancer is a bile salt. The bile salt can be cholic acid, dehydrocholic acid, deoxycholic acid, glucholic acid, glycholic acid, glycodeoxycholic acid, taurocholic acid, taurodeoxycholic acid, chenodeoxycholic acid, ursodeoxycholic acid, sodium tauro-24,25-dihydro-fusidate, sodium glycodihydrofusidate, polyoxyethylene-9-lauryl ether or a pharmaceutically acceptable salt thereof.

In another embodiment, the penetration enhancer is a chelating agent. The chelating agent can be EDTA, citric acid, a salicyclate, a N-acyl derivative of collagen, laureth-9, an N-amino acyl derivative of a beta-diketone or a mixture thereof.

In another embodiment, the penetration enhancer is a surfactant, e.g., an ionic or nonionic surfactant. The surfactant can be sodium lauryl sulfate, polyoxyethylene-9-lauryl ether, polyoxyethylene-20-cetyl ether, a perfluorchemical emulsion or mixture thereof.

In another embodiment, the penetration enhancer can be selected from a group consisting of unsaturated cyclic ureas, 1-alkyl-alkones, 1-alkenylazacyclo-alakanones, steroidal anti-inflammatory agents and mixtures thereof. In yet another embodiment the penetration enhancer can be a glycol, a pyrrol, an azone, or a terpenes.

In one aspect, the invention features a pharmaceutical composition including an RNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a form suitable for oral delivery. In one embodiment, oral delivery can be used to deliver an iRNA agent composition to a cell or a region of the gastro-intestinal tract, e.g., small intestine, colon (e.g., to treat a colon cancer), and so forth. The oral delivery form can be tablets, capsules or gel capsules. In one embodiment, the iRNA agent of the pharmaceutical composition modulates expression of a cellular adhesion protein, modulates a rate of cellular proliferation, or has biological activity against eukaryotic pathogens or retroviruses. In another embodiment, the pharmaceutical composition includes an enteric material that substantially prevents dissolution of the tablets, capsules or gel capsules in a mammalian stomach. In a preferred embodiment the enteric material is a coating. The coating can be acetate phthalate, propylene glycol, sorbitan monoleate, cellulose acetate trimellitate, hydroxy propyl methylcellulose phthalate or cellulose acetate phthalate.

In another embodiment, the oral dosage form of the pharmaceutical composition includes a penetration enhancer. The penetration enhancer can be a bile salt or a fatty acid. The bile salt can be ursodeoxycholic acid, chenodeoxycholic acid, and salts thereof. The fatty acid can be capric acid, lauric acid, and salts thereof.

In another embodiment, the oral dosage form of the pharmaceutical composition includes an excipient. In one example the excipient is polyethyleneglycol. In another example the excipient is precirol.

In another embodiment, the oral dosage form of the pharmaceutical composition includes a plasticizer. The plasticizer can be diethyl phthalate, triacetin dibutyl sebacate, dibutyl phthalate or triethyl citrate.

In one aspect, the invention features a pharmaceutical composition including an iRNA agent and a delivery vehicle. In one embodiment, the iRNA agent is (a) is 19-25 nucleotides long, preferably 21-23 nucleotides, (b) is complementary to an endogenous target RNA, and, optionally, (c) includes at least one 3' overhang 1-5 nucleotides long.

In one embodiment, the delivery vehicle can deliver an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) to a cell by a topical route of administration. The delivery vehicle can be microscopic vesicles. In one example the microscopic vesicles are liposomes. In a preferred embodiment the liposomes are cationic liposomes. In another example the microscopic vesicles are micelles. In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in an injectable dosage form. In one embodiment, the injectable dosage form of the pharmaceutical composition includes sterile aqueous solutions or dispersions and sterile powders. In a preferred embodiment the sterile solution can include a diluent such as water; saline solution; fixed oils, polyethylene glycols, glycerin, or propylene glycol.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in oral dosage form. In one embodiment, the oral dosage form is selected from the group consisting of tablets, capsules and gel capsules. In another embodiment, the pharmaceutical composition includes an enteric material that substantially prevents dissolution of the tablets, capsules or gel capsules in a mammalian stomach. In a preferred embodiment the enteric material is a coating. The coating can be acetate phthalate, propylene glycol, sorbitan monoleate, cellulose acetate trimellitate, hydroxy propyl methyl cellulose phthalate or cellulose acetate phthalate. In one embodiment, the oral dosage form of the pharmaceutical composition includes a penetration enhancer, e.g., a penetration enhancer described herein.

In another embodiment, the oral dosage form of the pharmaceutical composition includes an excipient. In one example the excipient is polyethyleneglycol. In another example the excipient is precirol.

In another embodiment, the oral dosage form of the pharmaceutical composition includes a plasticizer. The plasticizer can be diethyl phthalate, triacetin dibutyl sebacate, dibutyl phthalate or triethyl citrate.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a rectal dosage form. In one embodiment, the rectal dosage form is an enema. In another embodiment, the rectal dosage form is a suppository.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a vaginal dosage form. In one embodiment, the vaginal dosage form is a suppository. In another embodiment, the vaginal dosage form is a foam, cream, or gel.

In one aspect, the invention features a pharmaceutical composition including an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) in a pulmonary or nasal dosage form. In one embodiment, the iRNA agent is incorporated into a particle, e.g., a macroparticle, e.g., a microsphere. The particle can be produced by spray drying, lyophilization, evaporation, fluid bed drying, vacuum drying, or a combination thereof. The microsphere can be formulated as a suspension, a powder, or an implantable solid.

In one aspect, the invention features a spray-dried iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof) composition suitable for inhalation by a subject, including: (a) a therapeutically effective amount of a iRNA agent suitable for treating a condition in the subject by inhalation; (b) a pharmaceutically acceptable excipient selected from the group consisting of carbohydrates and amino acids; and (c) optionally, a dispersibility-enhancing amount of a physiologically-acceptable, water-soluble polypeptide.

In one embodiment, the excipient is a carbohydrate. The carbohydrate can be selected from the group consisting of monosaccharides, disaccharides, trisaccharides, and polysaccharides. In a preferred embodiment the carbohydrate is a monosaccharide selected from the group consisting of dextrose, galactose, mannitol, D-mannose, sorbitol, and sorbose. In another preferred embodiment the carbohydrate is a disaccharide selected from the group consisting of lactose, maltose, sucrose, and trehalose.

In another embodiment, the excipient is an amino acid. In one embodiment, the amino acid is a hydrophobic amino acid. In a preferred embodiment the hydrophobic amino acid is selected from the group consisting of alanine, isoleucine, leucine, methionine, phenylalanine, proline, tryptophan, and valine. In yet another embodiment the amino acid is a polar amino acid. In a preferred embodiment the amino acid is selected from the group consisting of arginine, histidine, lysine, cysteine, glycine, glutamine, serine, threonine, tyrosine, aspartic acid and glutamic acid.

In one embodiment, the dispersibility-enhancing polypeptide is selected from the group consisting of human serum albumin, α-lactalbumin, trypsinogen, and polyalanine.

In one embodiment, the spray-dried iRNA agent composition includes particles having a mass median diameter (MD) of less than 10 microns. In another embodiment, the spray-dried iRNA agent composition includes particles having a mass median diameter of less than 5 microns. In yet another embodiment the spray-dried iRNA agent composition includes particles having a mass median aerodynamic diameter (MMAD) of less than 5 microns.

In certain other aspects, the invention provides kits that include a suitable container containing a pharmaceutical formulation of an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof). In certain embodiments the individual components of the pharmaceutical formulation may be provided in one container. Alternatively, it may be desirable to provide the components of the pharmaceutical formulation separately in two or more containers, e.g., one container for an iRNA agent preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

In another aspect, the invention features a device, e.g., an implantable device, wherein the device can dispense or administer a composition that includes an iRNA agent, e.g., a double-stranded iRNA agent, or sRNA agent, (e.g., a precursor, e.g., a larger iRNA agent which can be processed into a sRNA agent, or a DNA which encodes an iRNA agent, e.g., a double-stranded iRNA agent, or sRNA agent, or precursor thereof), e.g., a iRNA agent that silences an endogenous transcript. In one embodiment, the device is coated with the composition. In another embodiment the iRNA agent is disposed within the device. In another embodiment, the device includes a mechanism to dispense a unit dose of the composition. In other embodiments the device releases the composition continuously, e.g., by diffusion. Exemplary devices include stents, catheters, pumps, artificial organs or organ components (e.g., artificial heart, a heart valve, etc.), and sutures.

As used herein, the term "crystalline" describes a solid having the structure or characteristics of a crystal, i.e., particles of three-dimensional structure in which the plane faces intersect at definite angles and in which there is a regular internal structure. The compositions of the invention may have different crystalline forms. Crystalline forms can be prepared by a variety of methods, including, for example, spray drying.

The invention is further illustrated by the following examples, which should not be construed as further limiting.

EXAMPLES

Example 1

Inhibition of Endogenous ApoM Gene Expression in Mice

Apolipoprotein M (ApoM) is a human apolipoprotein predominantly present in high-density lipoprotein (HDL) in plasma. ApoM is reported to be expressed exclusively in liver and in kidney (Xu N et al., Biochem J Biol Chem 1999 Oct. 29; 274(44):31286-90). Mouse ApoM is a 21 kD membrane associated protein, and, in serum, the protein is associated with HDL particles. ApoM gene expression is regulated by the transcription factor hepatocyte nuclear factor 1 alpha (Hnf-1α), as Hnf-1α$^{-/-}$ mice are ApoM deficient. In humans, mutations in the HNF-1 alpha gene represent a common cause of maturity-onset diabetes of the young (MODY).

A variety of test iRNAs were synthesized to target the mouse ApoM gene. This gene was chosen in part because of its high expression levels and exclusive activity in the liver and kidney.

Three different classes of dsRNA agents were synthesized, each class having different modifications and features at the 5' and 3' ends, see Table 4.

TABLE 4

Targeted ORF's

| | |
|---|---|
| 5 The23mer: AAGTTTGGGCAGCTCTGCTCT | (SEQ ID NO: 6708) |
| 19 The23mer: AAGTGGACATACCGATTGACT | (SEQ ID NO: 6709) |
| 25 The23mer: AACTCAGAACTGAAGGGCGCC | (SEQ ID NO: 6710) |
| 27 The23mer: AAGGGCGCCCAGACATGAAAA | (SEQ ID NO: 6711) |

3'-UTR (beginning at 645)

| | |
|---|---|
| 42: AAGATAGGAGCCCAGCTTCGA | (SEQ ID NO: 6712) |

Class I
21-nt iRNAs, t, deoxythymidine; p, phosphate

| | | |
|---|---|---|
| pGUUUGGGCAGCUCUGCUCUtt | (SEQ ID NO: 6712) | #1 |
| pAGAGCAGAGCUGCCCAAACtt | (SEQ ID NO: 6713) | |
| pGUGGACAUACCGAUUGACUtt | (SEQ ID NO: 6714) | #2 |
| pAGUCAAUCGGUAUGUCCACtt | (SEQ ID NO: 6715) | |
| pCUCAGAACUGAAGGGCGCCtt | (SEQ ID NO: 6716) | #3 |
| pGGCGCCCUUCAGUUCUGAGtt | (SEQ ID NO: 6717) | |
| pGAUAGGAGCCCAGCUUCGAtt | (SEQ ID NO: 6718) | #4 |
| pUCGAAGCUGGGCUCCUAUCtt | (SEQ ID NO: 6719) | |

Class II
21-nt iRNAs, t, deoxythymidine;
p, phosphate; ps, thiophosphate

| | | |
|---|---|---|
| pGUUUGGGCAGCUCUGCUCpsUpstpst | (SEQ ID NO: 6720) | #11 |
| pAGAGCAGAGCUGCCCAAApsCpstpst | (SEQ ID NO: 6721) | |
| pGUGGACAUACCGAUUGACpsUpstpst | (SEQ ID NO: 6722) | #13 |
| pAGUCAAUCGGUAUGUCCApsCpstpst | (SEQ ID NO: 6723) | |
| pCUCAGAACUGAAGGGCGCpsCpstpst | (SEQ ID NO: 6724) | #15 |
| pGGCGCCCUUCAGUUCUGApsGpstpst | (SEQ ID NO: 6725) | |
| pGAUAGGAGCCCAGCUUCGpsApstpst | (SEQ ID NO: 6726) | #17 |
| pUCGAAGCUGGGCUCCUAUpsCpstpst | (SEQ ID NO: 6727) | |

Class III
23-nt antisense, 21-nt sense, blunt-ended 5'-as

| | | |
|---|---|---|
| GUUUGGGCAGCUCUGCUCUCU | (SEQ ID NO: 6728) | #19 |
| AGAGAGCAGAGCUGCCCAAACUU | (SEQ ID NO: 6729) | |
| GUGGACAUACCGAUUGACUGA | (SEQ ID NO: 6730) | #21 |
| UCAGUCAAUCGGUAUGUCCACUU | (SEQ ID NO: 6731) | |

TABLE 4-continued

| | | |
|---|---|---|
| CUCAGAACUGAAGGGCGCCCA | (SEQ ID NO: 6732) | #23 |
| PUGGGCGCCCUUCAGUUCUGAGUU | (SEQ ID NO: 6733) | |
| GAUAGGAGCCCAGCUUCGAGU | (SEQ ID NO: 6734) | #25 |
| ACUCGAAGCUGGGCUCCUAUCUU | (SEQ ID NO: 6735) | |

Class I dsRNAs consisted of 21 nucleotide paired sense and antisense strands. The sense and antisense strands were each phosphorylated at their 5' ends. The double stranded region was 19 nucleotides long and consisted of ribonucleotides. The 3' end of each strand created a two nucleotide overhang consisting of two deoxyribonucleotide thymidines. See constructs #1-4 in Table 4.

Class II dsRNAs were also 21 nucleotides long, with a 19 nucleotide double strand region. The sense and antisense strands were each phosphorylated at their 5' ends. The three 3' terminal nucleotides of the sense and antisense strands were phosphorothioate deoxyribonucleotides, and the two terminal phosphorothioate thymidines were unpaired, creating a 3' overhang region at each end of the iRNA molecule. See constructs 11, 13, 15, and 17 in Table 4.

Class III dsRNAs included a 23 ribonucleotide antisense strand and a 21 ribonucleotide sense strand, to form a construct having a blunt 5' and a 3' overhang region. See constructs 19, 21, 23, and 25 in Table 4.

Within each of the three classes of iRNAs, the four dsRNA molecules were designed to target four different regions of the ApoM transcript. dsRNAs 1, 11, and 19 targeted the 5' end of the open reading frame (ORF). dsRNAs 2, 13, and 21, and 3, 15, and 23, targeted two internal regions (one 5' proximal and one 3' proximal) of the ORF, and the 4, 17, and 25 iRNA constructs targeted to a region of the 3' untranslated sequence (3' UTS) of the ApoM mRNA. This is summarized in Table 5.

TABLE 5 iRNA molecules targeted to mouse ApoM

| | iRNA targeted to 5' end of ORF | iRNA targeted to middle ORF (5' proximal) | iRNA targeted to middle ORF (3' proximal) | iRNA targeted to 3'UTS |
|---|---|---|---|---|
| Class I | 1 | 2 | 3 | 4 |
| Class II | 11 | 13 | 15 | 17 |
| Class III | 19 | 21 | 23 | 25 |

CD1 mice (6-8 weeks old, ~35 g) were administered one of the test iRNAs in PBS solution. Two hundred micrograms of iRNA in a volume of solution equal to 10% body weight (~5.7 mg iRNA/kg mouse) was administered by the method of high pressure tail vein injection, over a 10-20 sec. time interval. After a 24 h recovery period, a second injection was performed using the same dose and mode of administration as the first injection, and following another 24 h, a third and final injection was administered, also using the same dose and mode of administration. After a final 24 h recovery, the mouse was sacrificed, serum was collected and the liver and kidney harvested to assay for an affect on ApoM gene expression. Expression was monitored by quantitative RT-PCR and Western blot analyses. This experiment was repeated for each of the iRNAs listed in table 4.

Class I iRNAs did not alter ApoM RNA levels in mice, as indicated by quantitative RT-PCR. This is in contrast to the effect of these iRNAs in cultured HepG2 cells. Cells cotransfected with a plasmid expressing exogenous ApoM RNA under a CMV promoter and a class I iRNA demonstrated a 25% or greater reduction in ApoM RNA concentrations as compared to control transfections. The iRNA molecules 1, 2 and 3 each caused a 75% decrease in exogenous ApoM mRNA levels.

Class II iRNAs reduced liver and kidney ApoM mRNA levels by ~30-85%. The iRNA molecule "13" elicited the most dramatic reduction in mRNA levels; quantitative RT-PCR indicated a decrease of about 85% in liver tissue. Serum ApoM protein levels were also reduced as was evidenced by Western blot analysis. The iRNAs 11, 13 and 15, reduced protein levels by about 50%, while iRNA 17 had the mildest effect, reducing levels only by ~15-20%.

Class III iRNAs (constructs 19, 21, and 23) reduced serum Apo levels by ~40-50%.

To determine the effect of dosage on iRNA mediated ApoM inhibition, the experiment described above was repeated with three injections of 50 µg iRNA "11" (~1.4 mg iRNA/kg mouse). This lower dosage of iRNA resulted in a reduction of serum ApoM levels of about 50%. This is compared with the reduction seen with the 200 µg injections, which reduced serum levels by 25-45%. These results indicated the lower dosage amounts of iRNAs were effective.

In an effort to increase iRNA uptake by cells, iRNAs were precomplexed with lipofectamine prior to tail vein injections. ApoM protein levels were about 50% of wildtype levels in mice injected with iRNA "11" when the molecules were preincubated with lipofectamine; ApoM levels were also about 50% of wildtype when mice were injected with iRNA "11" that was not precomplexed with lipofectamine.

These experiments revealed that modified iRNAs can greatly influence RNAi-mediated gene silencing. As demonstrated herein, modifications including phosphorothioate nucleotides are particularly effective at decreasing target protein levels.

Example 2

ApoB Protein as a Therapeutic Target for Lipid-Based Diseases

Apolipoprotein B (apoB) is a candidate target gene for the development of novel therapies for lipid-based diseases.

Methods described herein can be used to evaluate the efficacy of a particular siRNA as a therapeutic tool for treating lipid metabolism disorders resulting elevated apoB levels. Use of siRNA duplexes to selectively bind and inactivate the target apoB mRNA is an approach to treat these disorders.

Two approaches:

i) Inhibition of apoB in ex-vivo models by transfecting siRNA duplexes homologous to human apoB mRNA in a human hepatoma cell line (Hep G2) and monitor the level of the protein and the RNA using the Western blotting and RT-PCR methods, respectively. siRNA molecules that efficiently inhibit apoB expression will be tested for similar effects in vivo.

ii) In vivo trials using an apoB transgenic mouse model (apoB100 Transgenic Mice, C57BL/6NTac-TgN (APOB100), Order Model #'s: 1004-T (hemizygotes), B6 (control)). siRNA duplexes are designed to target apoB-100 or CETP/apoB double transgenic mice which express both cholesteryl ester transfer protein (CETP) and apoB. The effect of the siRNA on gene expression in vivo can be measured by monitoring the HDL/LDL cholesterol level in serum. The results of these experiments would indicate the therapeutic potential of siRNAs to treat lipid-based diseases, including hypercholesterolemia, HDL/LDL cholesterol imbalance, familial combined hyperlipidemia, and acquired hyperlipidemia.

Background Fats, in the form of triglycerides, are ideal for energy storage because they are highly reduced and anhydrous. An adipocyte (or fat cell) consists of a nucleus, a cell membrane, and triglycerides, and its function is to store triglycerides.

The lipid portion of the human diet consists largely of triglycerides and cholesterol (and its esters). These must be emulsified and digested to be absorbed. Specifically, fats (triacylglycerols) are ingested. Bile (bile acids, salts, and cholesterol), which is made in the liver, is secreted by the gall bladder. Pancreatic lipase digests the triglycerides to fatty acids, and also digests di-, and mono-acylglycerols, which are absorbed by intestinal epithelial cells and then are resynthesized into triacylglycerols once inside the cells. These triglycerides and some cholesterols are combined with apolipoproteins to produce chylomicrons. Chylomicrons consist of approximately 95% triglycerides. The chylomicrons transport fatty acids to peripheral tissues. Any excess fat is stored in adipose tissue.

Lipid transport and clearance from the blood into cells, and from the cells into the blood and the liver, is mediated by the lipoprotein transport proteins. This class of approximately 17 proteins can be divided into three groups: Apolipoproteins, lipoprotein processing proteins, and lipoprotein receptors.

Apolipoproteins coat lipoprotein particles, and include the A-I, A-II, A-IV, B, CI, CII, CIII, D, E, Apo(a) proteins. Lipoprotein processing proteins include lipoprotein lipase, hepatic lipase, lecithin cholesterol acyltransferase and cholesterol ester transfer protein. Lipoprotein receptors include the low density lipoprotein (LDL) receptor, chylomicron-remnant receptor (the LDL receptor like protein or LDL receptor related protein—LRP) and the scavenger receptor.

Lipoprotein Metabolism Since the triglycerides, cholesterol esters, and cholesterol absorbed into the small intestine are not soluble in aqueous medium, they must be combined with suitable proteins (apolipoproteins) in order to prevent them from forming large oil droplets. The resulting lipoproteins undergo a type of metabolism as they pass through the bloodstream and certain organs (notably the liver).

Also synthesized in the liver is high density lipoprotein (HDL), which contains the apoproteins A-1, A-2, C-1, and D; HDL collects cholesterol from peripheral tissues and blood vessels and returns it to the liver. LDL is taken up by specific cell surface receptors into an endosome, which fuses with a lysosome where cholesterol ester is converted to free cholesterol. The apoproteins (including apo B-100) are digested to amino acids. The receptor protein is recycled to the cell membrane.

The free cholesterol formed by this process has two fates. First, it can move to the endoplasmic reticulum (ER), where it can inhibit HMG-CoA reductase, the synthesis of HMG-CoA reductase, and the synthesis of cell surface receptors for LDL. Also in the ER, cholesterol can speed up the degradation of HMG-CoA reductase. The free cholesterol can also be converted by acyl-CoA and acyl transferase (ACAT) to cholesterol esters, which form oil droplets.

ApoB is the major apolipoprotein of chylomicrons of very low density lipoproteins (VLDL, which carry most of the plasma triglyceride) and low density lipoprotein (LDL, which carry most of the plasma cholesterol). ApoB exists in human plasma in two isoforms, apoB-48 and apoB-100.

ApoB-100 is the major physiological ligand for the LDL receptor. The ApoB precursor has 4563 amino acids, and the mature apoB-100 has 4536 amino acid residues. The LDL-binding domain of ApoB-100 is proposed to be located between residues 3129 and 3532. ApoB-100 is synthesized in the liver and is required for the assembly of very low density lipoproteins VLDL and for the preparation of apoB-100 to transport triglycerides (TG) and cholesterol from the liver to other tissues. ApoB-100 does not interchange between lipoprotein particles, as do the other lipoproteins, and it is found in IDL and LDL particles. After the removal of apolipoproteins A, E and C, apoB is incorporation into VLDL by hepatocytes. ApoB-48 is present in chylomicrons and plays an essential role in the intestinal absorption of dietary fats. ApoB-48 is synthesized in the small intestine. It comprises the N-terminal 48% of apoB-100 and is produced by a post-transcriptional apoB-100 mRNA editing event at codon 2153 (C to U). This editing event is a product of the apoBEC-1b enzyme, which is expressed in the intestine. This editing event creates a stop codon instead of a glutamine codon, and therefore apoB-48, instead of apoB-100 is expressed in the intestine (apoB-100 is expressed in the liver).

There is also strong evidence that plasma apoB levels may be a better index of the risk of coronary artery disease (CAD) than total or LDL cholesterol levels. Clinical studies have demonstrated the value of measuring apoB in hypertriglyceridemic, hypercholesterolemic and normalipidemic subjects.

TABLE 6

Reference Range Lipid level in the Blood

| Lipid | Range (mmols/L) |
| --- | --- |
| Plasma Cholesterol | 3.5-6.5 |
| Low density lipoprotein | 1.55-4.4 |
| Very low density lipoprotein | 0.128-0.645 |
| High density lipoprotein/triglycerides | 0.5-2.1 |
| Total lipid | 4.0-10 g/L |

Molecular Genetics of Lipid Metabolism in Both Humans and Induced Mutant Mouse Models Elevated plasma levels of LDL and apoB are associated with a higher risk for atherosclerosis and coronary heart disease, a leading cause of mortality. ApoB is the mandatory constituent of LDL particles. In addition to its role in lipoprotein metabolism, apoB has also been implicated as a factor in male infertility and fetal development. Furthermore, two quantitative trait loci regulating plasma apoB levels have been discovered, through the use of transgenic mouse models. Future experiments will facilitate the identification of human orthologous genes encoding regulators of plasma apoB levels. These loci are candidate therapeutic targets for human disorders characterized by altered plasma apoB levels. Such disorders include non-apoB linked hypobetalipoproteinemia and familial combined hyperlipidemia. The identification of these genetic loci would also reveal possible new pathways involved in the regulation of apoB secretion, potentially providing novel sites for pharmacological therapy.

Diseases and Clinical Pharmacology Familial combined hyperlipemia (FCHL) affects an estimated one in 10 Americans. FCHL can cause premature heart disease.

Familial Hypercholesterolemia (high level of apo B) A common genetic disorder of lipid metabolism. Familial hypercholesterolemia is characterized by elevated serum TC in association with xanthelasma, tendon and tuberous xanthomas, accelerated atherosclerosis, and early death from myocardial infarction (MI). It is caused by absent or defective LDL cell receptors, resulting in delayed LDL clearance, an increase in plasma LDL levels, and an accumulation of LDL cholesterol in macrophages over joints and pressure points, and in blood vessels.

Atherosclerosis (high level of apo B) Atherosclerosis develops as a deposition of cholesterol and fat in the arterial wall due to disturbances in lipid transport and clearance from the blood into cells and from the cells to blood and the liver.

Clinical studies have demonstrated that elevation of total cholesterol (TC), low-density lipoprotein cholesterol (LDL-C) and apoB-100 promote human atherosclerosis. Similarly, decreased levels of high-density lipoprotein cholesterol (HDL-C) are associated with the development of atherosclerosis.

ApoB may be factor in the genetic cause of high cholesterol.

The risk of coronary artery disease (CAD) (high level of apo B) Cardiovascular disease, including coronary heart disease and stroke, is a leading cause of death and disability. The major risk factors include age, gender, elevated low-density lipoprotein cholesterol blood levels, decreased high-density lipoprotein cholesterol levels, cigarette smoking, hypertension, and diabetes. Emerging risk factors include elevated lipoprotein (a), remnant lipoproteins, and C reactive protein. Dietary intake, physical activity and genetics also impact cardiovascular risk. Hypertension and age are the major risk factors for stroke.

Abetalipoproteinemia, an inherited human disease characterized by a near-complete absence of apoB-containing lipoproteins in the plasma, is caused by mutations in the gene for microsomal triglyceride transfer protein (MTP).

Model for human atherosclerosis (Lipoprotein A transgenic mouse) Numerous studies have demonstrated that an elevated plasma level of lipoprotein (a) (Lp(a)) is a major independent risk factor for coronary heart disease (CHD). Current therapies, however, have little or no effect on apo(a) levels and the homology between apo(a) and plasminogen presents barriers to drug development. Lp(a) particles consist of apo(a) and apoB-100 proteins, and they are found only in primates and the hedgehog. The development of LPA transgenic mouse requires the creation of animals that express both human apoB and apo(a) transgenes to achieve assembly of LP(a). An atherosclerosis mouse model would facilitate the study of the disease process and factors influencing it, and further would facilitate the development of therapeutic or preventive agents. There are several strategies for gene-oriented therapy. For example, the missing or non-functional gene can be replaced, or unwanted gene activity can be inhibited.

Model for lipid Metabolism and Atherosclerosis DNX Transgenic Sciences has demonstrated that both CETP/ApoB and ApoB transgenic mice develop atherosclerotic plaques.

Model for apoB-100 overexpression The apoB-100 transgenic mice express high levels of human apoB-100. They consequently demonstrate elevated serum levels of LDL cholesterol. After 6 months on a high-fat diet, the mice develop significant foam cell accumulation under the endothelium and within the media, as well as cholesterol crystals and fibrotic lesions.

Model for Cholesteryl ester transfer protein over expression The apoB-100 transgenic mice express the human enzyme, CETP, and consequently demonstrate a dramatically reduced level of serum HDL cholesterol.

Model for apoB-100 and CETP overexpression The apoB-100 transgenic mice express both CETP and apoB-100, resulting in mice with a human like serum HDL/LDL distribution. Following 6 months on a high-fat diet these mice develop significant foam cell accumulation underlying the endothelium and within the media, as well as cholesterol crystals and fibrotic lesions.

ApoB100 Transgenic Mice (Order Model #'s: 1004-T (Hemizygotes), B6 (Control))

These mice express high levels of human apoB-100, resulting in mice with elevated serum levels of LDL cholesterol. These mice are useful in identifying and evaluating compounds to reduce elevated levels of LDL cholesterol and the risk of atherosclerosis. When fed a high fat cholesterol diet, these mice develop significant foam cell accumulation underly the endothelium and within the media, and have significantly more complex atherosclerotic lesions than control animals.

Double Transgenic Mice, CETP/ApoB100 (Order Model #: 1007-TT) These mice express both CETP and apoB-100, resulting in a human-like serum HDL/LDL distribution. These mice are useful for evaluating compounds to treat hypercholesterolemia or HDL/LDL cholesterol imbalance to reduce the risk of developing atherosclerosis. When fed a high fat high cholesterol diet, these mice develop significant foam cell accumulation underlying the endothelium and within the media, and have significantly more complex atherosclerotic lesions than control animals.

ApoE gene knockout mouse Homozygous apoE knockout mice exhibit strong hypercholesterolemia, primarily due to elevated levels of VLDL and IDL caused by a defect in lipoprotein clearance from plasma. These mice develop atherosclerotic lesions which progress with age and resemble human lesions (Zhang et al., Science 258:46-71, 1992; Plump et al., Cell 71:343-353, 1992; Nakashima et al., Arterioscler Thromp. 14:133-140, 1994; Reddick et al., Arterioscler Tromb. 14:141-147, 1994). These mice are a promising model for studying the effect of diet and drugs on atherosclerosis.

Low density lipoprotein receptor (LDLR) mediates lipoprotein clearance from plasma through the recognition of apoB and apoE on the surface of lipoprotein particles. Humans, who lack or have a decreased number of the LDL receptors, have familial hypercholesterolemia and develop CHD at an early age.

ApoE Knockout Mice (Order Model #: APOE-M) The apoE knockout mouse was created by gene targeting in embryonic stem cells to disrupt the apoE gene. ApoE, a glycoprotein, is a structural component of very low density lipoprotein (VLDL) synthesized by the liver and intestinally synthesized chylomicrons. It is also a constituent of a subclass of high density lipoproteins (HDLs) involved in cholesterol transport activity among cells. One of the most important roles of apoE is to mediate high affinity binding of chylomicrons and VLDL particles that contain apoE to the low density lipoprotein (LDL) receptor. This allows for the specific uptake of these particles by the liver which is necessary for transport preventing the accumulation in plasma of cholesterol-rich remnants. The homozygous inactivation of the apoE gene results in animals that are devoid of apoE in their sera. The mice appear to develop normally, but they exhibit five times the normal serum plasma cholesterol and spontaneous atherosclerotic lesions. This is similar to a disease in people who have a variant form of the apoE gene that is defective in binding to the LDL receptor and are at risk for early development of atherosclerosis and increased plasma triglyceride and cholesterol levels. There are indications that apoE is also involved in immune system regulation, nerve regeneration and muscle differentiation. The apoE knockout mice can be used to study the role of apoE in lipid metabolism, atherogenesis, and nerve injury, and to investigate intervention therapies that modify the atherogenic process.

Apoe4 Targeted Replacement Mouse (Order Model #: 001549-M) ApoE is a plasma protein involved in cholesterol transport, and the three human isoforms (E2, E3, and E4) have been associated with atherosclerosis and Alzheimer's disease. Gene targeting of 129 ES cells was used to replace the coding sequence of mouse apoE with human APOE4 without disturbing the murine regulatory sequences. The E4 isoform occurs in approximately 14% of the human population and is associated with increased plasma cholesterol and a greater risk of coronary artery disease. The Taconic apoE4 Targeted Replacement model has normal plasma cholesterol and triglyceride levels, but altered quantities of different plasma lipoprotein particles. This model also has delayed plasma clearance of cholesterol-rich lipoprotein particles (VLDL), with only half the clearance rate seen in the apoE3 Targeted Replacement model. Like the apoE3 model, the apoE4 mice develop altered plasma lipoprotein values and atherosclerotic plaques on an atherogenic diet. However, the atherosclerosis is more severe in the apoE4 model, with larger plaques and cholesterol apoE and apoB-48 levels twice that seen in the apoE3 model. The Taconic apoE4 Targeted Replacement model, along with the apoE2 and apoE3 Targeted Replacement Mice, provide an excellent tool for in vivo study of the human apoE isoforms.

CETP Transgenic Mice (Order Model #: 1003-T) These animals express the human plasma enzyme, CETP, resulting in mice with a dramatic reduction in serum HDL cholesterol. The mice can be useful in identifying and evaluating compounds that increase the levels of HDL cholesterol for reducing the risk of developing atherosclerosis Transgene/Promoter: human apolipoprotein A-I These mice produce mouse HDL cholesterol particles that contain human apolipoprotein A-I. Transgenic expression is life-long in both sexes (Biochemical Genetics and Metabolism Laboratory, Rockefeller University, NY City).

A Mouse Model for Abetalipoproteinemia Abetalipoproteinemia, an inherited human disease characterized by a near-complete absence of apoB-containing lipoproteins in the plasma, is caused by mutations in the gene for microsomal triglyceride transfer protein (MTP). Gene targeting was used to knock out the mouse MTP gene (Mttp). In heterozygous knockout mice (Mttp$^{+/-}$), the MTP mRNA, protein, and activity levels were reduced by 50% in both liver and intestine. Recent studies with heterozygous MTP knockout mice have suggested that half-normal levels of MTP in the liver reduce apoB secretion. They hypothesized that reduced apoB secretion in the setting of half-normal MTP levels might be caused by a reduced MTP:apoB ratio in the endoplasmic reticulum, which would reduce the number of apoB-MTP interactions. If this hypothesis were true, half-normal levels of MTP might have little impact on lipoprotein secretion in the setting of half-normal levels of apoB synthesis (since the ratio of MTP to apoB would not be abnormally low) and might cause an exaggerated reduction in lipoprotein secretion in the setting of apoB overexpression (since the ratio of MTP to apoB would be even lower). To test this hypothesis, they examined the effects of heterozygous MTP deficiency on apoB metabolism in the setting of normal levels of apoB synthesis, half-normal levels of apoB synthesis (heterozygous Apob deficiency), and increased levels of apoB synthesis (transgenic overexpression of human apoB). Contrary to their expectations, half-normal levels of MTP reduced plasma apoB-100 levels to the same extent (~25-35%) at each level of apoB synthesis. In addition, apoB secretion from primary hepatocytes was reduced to a comparable extent at each level of apoB synthesis. Thus, these results indicate that the concentration of MTP within the endoplasmic reticulum, rather than the MTP:apoB ratio, is the critical determinant of lipoprotein secretion. Finally, heterozygosity for an apoB knockout mutation was found to lower plasma apoB-100 levels more than heterozygosity for an MTP knockout allele. Consistent with that result, hepatic triglyceride accumulation was greater in heterozygous apoB knockout mice than in heterozygous MTP knockout mice, Cre/loxP tissue-specific recombination techniques were also used to generate liver-specific Mttp knockout mice. Inactivation of the Mttp gene in the liver caused a striking reduction in very low density lipoprotein (VLDL) triglycerides and large reductions in both VLDL/low density lipoproteins (LDL) and high density lipoprotein cholesterol levels. Histologic studies in liver-specific knockout mice revealed moderate hepatic steatosis. Currently being tested is the hypothesis that accumulation of triglycerides in the liver renders the liver more susceptible to injury by a second insult (e.g., lipopolysaccharide).

Human apo B (apolipoprotein B) Transgene mice show apo B locus may hale a causative role male infertility The fertility of apoB (apolipoprotein B) (+/−) mice was recorded during the course of backcrossing (to C57BL/6J mice) and test mating. No apparent fertility problem was observed in female apoB (+/−) and wild-type female mice, as was documented by the presence of vaginal plugs in female mice. Although apoB (+/−) mice mated normally, only 40% of the animals from the second backcross generation produced any offspring within the 4-month test period. Of the animals that produced progeny, litters resulted from <50% of documented matings. In contrast, all wild-type mice (6/6—i.e., 100%) tested were fertile. These data suggest genetic influence on the infertility phenotype, as a small number of male heterozygotes were not sterile. Fertilization in vivo was dramatically impaired in male apoB (+/−) mice. 74% of eggs examined were fertilized by the sperm from wild-type mice, whereas only 3% of eggs examined were fertilized by the sperm from apoB (+/−) mice. The sperm counts of apoB (+/−) mice were mildly but significantly reduced compared with controls. However, the percentage of motile sperm was markedly reduced in the apoB (+/−) animals compared with that of the wild-type controls. Of the sperm from apoB (+/−) mice, 20% (i.e., 4.9% of the initial 20% motile sperm) remained motile after 6 hr of incubation, whereas 45% (i.e., 33.6% of the initial 69.5%) of the motile sperm retained motility in controls after this time. In vitro fertilization yielded no fertilized eggs in three attempts with apo B (+/−) mice, while wild-type controls showed a fertilization rate of 53%. However, sperm from apoB (+/−) mice fertilized 84% of eggs once the zona pellucida had been removed. Numerous sperm from apoB (+/−) mice were seen binding to zona-intact eggs. However, these sperm lost their motility when observed 4-6 hours after binding, showing that sperm from apoB (+/−) mice were unable to penetrate the zona pellucida but that the interaction between sperm and egg was probably not direct. Sperm binding to zona-free oocytes was abnormal. In the apoB (+/−) mice, sperm binding did not attenuate, even after pronuclei had clearly formed, suggesting that apoB deficiency results in abnormal surface interaction between the sperm and egg.

Knockout of the mouse apoB gene resulted in embryonic lethality in homozygotes, protection against diet-induced hypercholesterolemia in heterozygotes, and developmental abnormalities in mice.

Model of insulin resistance, dyslipidemia & overexpression of human apoB It was shown that the livers of apoB mice assemble and secrete increased numbers of VLDL particles.

Example 3

Treatment of Diabetes Type-2 with iRNA

Introduction The regulation of hepatic gluconeogenesis is an important process in the adjustment of the blood glucose level. Pathological changes in the glucose production of the liver are a central characteristic in type-2-diabetes. For example, the fasting hyperglycemia observed in patients with type-2-diabetes reflects the lack of inhibition of hepatic gluconeogenesis and glycogenolysis due to the underlying insulin resistance in this disease. Extreme conditions of insulin resistance can be observed for example in mice with a liver-specific insulin receptor knockout ('LIRKO'). These mice have an increased expression of the two rate-limiting gluconeogenic enzymes, phosphoenolpyruvate carboxykinase (PEPCK) and the glucose-6-phosphatase catalytic subunit (G6Pase). Insulin is known to repress both PEPCK and G6Pase gene expression at the transcriptional level and the signal transduction involved in the regulation of G6Pase and PEPCK gene expression by insulin is only partly understood. While PEPCK is involved in a very early step of hepatic gluconeogenesis (synthesis of phosphoenolpyruvate from oxaloacetate), G6Pase catalyzes the terminal step of both, gluconeogenesis and glycogenolysis, the cleavage of glucose-6-phosphate into phosphate and free glucose, which is then delivered into the blood stream.

The pharmacological intervention in the regulation of expression of PEPCK and G6Pase can be used for the treatment of the metabolic aberrations associated with diabetes. Hepatic glucose production can be reduced by an iRNA-based reduction of PEPCK and G6Pase enzymatic activity in subjects with type-2-diabetes.

Targets for iRNA

Glucose-6-Phosphatase (G6Pase)

G6Pase mRNA is expressed principally in liver and kidney, and in lower amounts in the small intestine. Membrane-bound G6Pase is associated with the endoplasmic reticulum. Low activities have been detected in skeletal muscle and in astrocytes as well.

G6Pase catalyzes the terminal step in gluconeogenesis and glycogenolysis. The activity of the enzyme is several fold higher in diabetic animals and probably in diabetic humans. Starvation and diabetes cause a 2-3-fold increase in G6Pase activity in the liver and a 2-4-fold increase in G6Pase mRNA.

Phosphoenolpyruvate Carboxykinase (PEPCK)

Overexpression of PEPCK in mice results in symptoms of type-2-diabetes mellitus. PEPCK overexpression results in a metabolic pattern that increases G6Pase mRNA and results in a selective decrease in insulin receptor substrate (IRS)-2 protein, decreased phosphatidylinositol 3-kinase activity, and reduced ability of insulin to suppress gluconeogenic gene expression.

TABLE 7

Other targets to inhibit hepatic glucose production

| Target | Comment |
|---|---|
| FKHR | good evidence for antidiabetic phenotype (Nakae et al., Nat Genetics 32: 245(2002) |
| Glucagon | |
| Glucagon receptor | |
| Glycogen phosphorylase | |
| PGC-1 (PPAR-Gamma Coactivator) | regulates the cAMP response (and probably the PKB/FKHR-regulation) on PEPCK/G6Pase |
| Fructose-1,6-bisphosphatase | |
| Glucose-6-phospate translocator | |
| Glucokinase inhibitory regulatory protein | |

Materials and Methods

Animals: BKS.Cg-m+/+ Lepr db mice, which contain a point mutation in the leptin receptor gene are used to examine the efficacy of iRNA for the targets listed above.

BKS.Cg-m+/+ Lepr db are available from the Jackson Laboratory (Stock Number 000642). These animals are obese at 3-4 weeks after birth, show elevation of plasma insulin at 10 to 14 days, elevation of blood sugar at 4 to 8 weeks, and uncontrolled rise in blood sugar. Exogenous insulin fails to control blood glucose levels and gluconeogenic activity increases.

The following numbers of male animals (age>12 weeks) would ideally be tested with the following iRNAs:

PEPCK, 2 sequences, 5 animals per sequence

G6Pase, 2 sequences, 5 animals per sequence 1 nonspecific sequence, 5 animals 1 control group (only injected, no siRNA), 5 animals 1 control group (not injected, no siRNA), 5 animals Reagents: Necessary reagents would ideally include a Glucometer Elite XL (Bayer, Pittsburgh, Pa.) for glucose quantification, and an Insulin Radioimmunoassay (RIA) kit (Amersham, Piscataway, N.J.) for insulin quanitation Assays:

G6P enzyme assays and PEPCK enzyme assays are used to measure the activity of the enzymes. Northern blotting is used to detect levels of G6Pase and PEPCK mRNA. Antibody-based techniques (e.g., immunoblotting, immunofluorescence) are used to detect levels of G6Pase and PEPCK protein. Glycogen staining is used to detect levels of glycogen in the liver. Histological analysis is performed to analyze tissues.

Gene Information:

G6Pase GenBank® No.: NM_008061, Mus musculus glucose-6-phosphatase, catalytic (G6pc), mRNA 1 . . . 2259, ORF 83 . . . 1156;

GenBank® No: U00445, Mus musculus glucose-6-phosphatase mRNA, complete cds 1 . . . 2259, ORF 83 . . . 1156

GenBank® No: BC013448

PEPCK

GenBank® No: NM_011044, Mus musculus phosphoenolpyruvate carboxykinase 1, cytosolic (Pck1), mRNA. 1 . . . 2618, ORF 141 . . . 2009

GenBank® No: AF009605.1

Administration of iRNA:

iRNA corresponding to the genes described above would be administered to mice with hydrodynamic injection. One control group of animals would be treated with Metformin as a positive control for reduction in hepatic glucose levels.

Experimental Protocol

Mice would be housed in a facility in which there is light from 7:00 AM to 7:00 PM. Mice would be fed ad libidum from 7:00 PM to 7:00 AM and fast from 7:00 AM to 7:00 PM.

Day 0: 7:00 PM: Approximately 100 μl blood would be drawn from the tail. Serum would be isolated to measure glucose, insulin, HbA1c (EDTA-blood), glucagon, FFAs, lactate, corticosterone, serum triglycerides.

Day 1-7: Blood glucose would be measured daily at 8:00 AM and 6:00 PM (approx. 3-5 μl; measured with a Haemoglucometer)

Day 8: Blood glucose would be measured daily at 8:00 AM and 6:00 PM. iRNA would be injected between 10:00 AM and 2:00 PM Day 9-20: Blood glucose would be measured daily at 8:00 AM and 6:00 PM.

Day 21: Mice would be sacrificed after 10 hours of fasting. Blood would be isolated. Glucose, insulin, HbA1c (EDTA-blood), glucagon, FFAs, lactate, corticosterone, serum triglycerides would be measured. Liver tissue would be isolated for histology, protein assays, RNA assays, glycogen quanitation, and enzyme assays.

Example 4

Inhibition of Glucose-6-Phosphatase iRNA In Vivo iRNA targeted to the Glucose-6-Phosphatase (G6P) gene was used to examine the effects of inhibition of G6P expression on glucose metabolism in vivo.

Female mice, 10 weeks of age, strain BKS.Cg-m+/+ Lepr db (The Jackson Laboratory) were used for in vivo analysis of enzymes of the hepatic glucose production. Mice were housed under conditions where it was light from 6:30 am to 6:30 pm. Mice were fed (ad libidum) during the night period and fasted during the day period.

On day 1, approximately 100 μl of blood was collected from test animals by puncturing the retroorbital plexus. On days 1-7, blood glucose was measured in blood obtained from tail veins (approximately 3-5 μl) using a Glucometer (Elite XL, Bayer). Blood glucose was sampled daily at 8 am and 6 pm.

On day 7 at approximately 2 pm, GL3 plasmid (10 μg) and siRNAs (100 μg G6Pase specific, *Renilla* nonspecific or no siRNA control) were delivered to animals using hydrodynamic coinjection.

On day 8, GL3 expression was analyzed by injection of luceferin (3 mg) after anaesthesia with avertin and imaging. This was done to control for successful hydrodynamic delivery.

On days 8-10, blood glucose was measured in blood obtained from tail veins (approximately 3-5 ml) using a Glucometer (Elite XL, Bayer).

On day 10, mice were sacrificed after 10 hours of fasting. Blood and liver were isolated from sacrificed animals.

Results: Coinjection of GL3 plasmid and G6Pase iRNA (G6P4) reduced blood glucose levels for the short term. Coinjection of GL3 plasmid and *Renilla* nonspecific iRNA had no effect on blood glucose levels.

Example 5

Selected Palindromic Sequences

Tables 8-13 below provide selected palindromic sequences from the following genes: human ApoB, human glucose-6-phosphatase, rat glucose-6-phosphatase, β-catenin, and hepatitis C virus (HCV).

TABLE 8

Selected palindromic sequences from human ApoB

| | Source | Start Index | End Index | | Match | Start Index | End Index | # | B |
|---|---|---|---|---|---|---|---|---|---|
| SEQ ID NO: 1 | ggccattccagaagggaag | 509 | 528 | SEQ ID NO: 1004 | cttccgttctgtaatggcc | 5795 | 5814 | 1 | 9 |
| SEQ ID NO: 2 | tgccatctcgagagttcca | 4099 | 4118 | SEQ ID NO: 1005 | tggaactctctccatggca | 10876 | 10895 | 1 | 8 |
| SEQ ID NO: 3 | catgtcaaacactttgtta | 7056 | 7075 | SEQ ID NO: 1006 | taacaaattccttgacatg | 7358 | 7377 | 1 | 8 |
| SEQ ID NO: 4 | tttgttataaatcttattg | 7068 | 7087 | SEQ ID NO: 1007 | caataagatcaatagcaaa | 8990 | 9009 | 1 | 8 |
| SEQ ID NO: 5 | tctggaaaagggtcatgga | 8880 | 8899 | SEQ ID NO: 1008 | tccatgtcccatttacaga | 11356 | 11375 | 1 | 8 |
| SEQ ID NO: 6 | cagctcttgttcaggtcca | 10900 | 10919 | SEQ ID NO: 1009 | tggacctgcaccaaagctg | 13952 | 13971 | 1 | 8 |
| SEQ ID NO: 7 | ggaggttccccagctctgc | 356 | 375 | SEQ ID NO: 1010 | gcagccctgggaaaactcc | 6447 | 6466 | 1 | 7 |
| SEQ ID NO: 8 | ctgttttgaagactctcca | 1081 | 1100 | SEQ ID NO: 1011 | tggagggtagtcataacag | 10327 | 10346 | 1 | 7 |
| SEQ ID NO: 9 | agtggctgaaacgtgtgca | 1297 | 1316 | SEQ ID NO: 1012 | tgcagagctttctgccact | 13508 | 13527 | 1 | 7 |
| SEQ ID NO: 10 | ccaaaatagaagggaatct | 2068 | 2087 | SEQ ID NO: 1013 | agattcctttgccttttgg | 4000 | 4019 | 1 | 7 |
| SEQ ID NO: 11 | tgaagagaagattgaattt | 3620 | 3639 | SEQ ID NO: 1014 | aaattctcttttcttttca | 9212 | 9231 | 1 | 7 |
| SEQ ID NO: 12 | agtggtggcaacaccagca | 4230 | 4249 | SEQ ID NO: 1015 | tgctagtgaggccaacact | 10649 | 10668 | 1 | 7 |
| SEQ ID NO: 13 | aaggctccacaagtcatca | 5950 | 5969 | SEQ ID NO: 1016 | tgatgatatctggaacctt | 10724 | 10743 | 1 | 7 |
| SEQ ID NO: 14 | gtcagccaggtttatagca | 7725 | 7744 | SEQ ID NO: 1017 | tgctaagaaccttactgac | 7781 | 7800 | 1 | 7 |
| SEQ ID NO: 15 | tgatatctggaaccttgaa | 10727 | 10746 | SEQ ID NO: 1018 | ttcactgttcctgaaatca | 7863 | 7882 | 1 | 7 |
| SEQ ID NO: 16 | gtcaagttgagcaatttct | 13423 | 13442 | SEQ ID NO: 1019 | agaaaaggcacaccttgac | 11072 | 11091 | 1 | 7 |
| SEQ ID NO: 17 | atccagatggaaaagggaa | 13480 | 13499 | SEQ ID NO: 1020 | ttccaatttccctgtggat | 3680 | 3699 | 1 | 7 |
| SEQ ID NO: 18 | atttgtttgtcaaagaagt | 4543 | 4562 | SEQ ID NO: 1021 | acttcagagaaatacaaat | 11401 | 11420 | 4 | 6 |
| SEQ ID NO: 19 | ctggaaaatgtcagcctgg | 204 | 223 | SEQ ID NO: 1022 | ccagacttccgtttaccag | 8235 | 8254 | 2 | 6 |
| SEQ ID NO: 20 | accaggaggttcttcttca | 1729 | 1748 | SEQ ID NO: 1023 | tgaagtgtagtctcctggt | 5089 | 5108 | 2 | 6 |
| SEQ ID NO: 21 | aaagaagttctgaaagaat | 1956 | 1975 | SEQ ID NO: 1024 | attccatcacaaatccttt | 9661 | 9680 | 2 | 6 |
| SEQ ID NO: 22 | gctacagcttatggctcca | 3570 | 3589 | SEQ ID NO: 1025 | tggatctaaatgcagtagc | 11623 | 11642 | 2 | 6 |
| SEQ ID NO: 23 | atcaatattgatcaatttg | 6414 | 6433 | SEQ ID NO: 1026 | caaagaagtcaagattgat | 4553 | 4572 | 2 | 6 |
| SEQ ID NO: 24 | gaattatcttttaaaacat | 7326 | 7345 | SEQ ID NO: 1027 | atgtgttaacaaaatattc | 11494 | 11513 | 2 | 6 |
| SEQ ID NO: 25 | cgaggcccgcgctgctggc | 130 | 149 | SEQ ID NO: 1028 | gccagaagtgagatcctcg | 3507 | 3526 | 1 | 6 |
| SEQ ID NO: 26 | acaactatgaggctgagag | 271 | 290 | SEQ ID NO: 1029 | ctctgagcaacaaatttgt | 10309 | 10328 | 1 | 6 |
| SEQ ID NO: 27 | gctgagagttccagtggag | 282 | 301 | SEQ ID NO: 1030 | ctccatggcaaatgtcagc | 10885 | 10904 | 1 | 6 |
| SEQ ID NO: 28 | tgaagaaaccaagaactc | 448 | 467 | SEQ ID NO: 1031 | gagtcattgaggttcttca | 4929 | 4948 | 1 | 6 |
| SEQ ID NO: 29 | cctacttacatcctgaaca | 558 | 577 | SEQ ID NO: 1032 | tgttcataagggaggtagg | 12766 | 12785 | 1 | 6 |
| SEQ ID NO: 30 | ctacttacatcctgaacat | 559 | 578 | SEQ ID NO: 1033 | atgttcataagggaggtag | 12765 | 12784 | 1 | 6 |
| SEQ ID NO: 31 | gagacagaagaagccaagc | 615 | 634 | SEQ ID NO: 1034 | gcttggttttgccagtctc | 2459 | 2478 | 1 | 6 |
| SEQ ID NO: 32 | cactcactttaccgtcaag | 671 | 690 | SEQ ID NO: 1035 | cttgaacacaaagtcagtg | 6000 | 6019 | 1 | 6 |
| SEQ ID NO: 33 | ctgatcagcagcagccagt | 822 | 841 | SEQ ID NO: 1036 | actgggaagtgcttatcag | 5237 | 5256 | 1 | 6 |
| SEQ ID NO: 34 | actggacgctaagaggaag | 854 | 873 | SEQ ID NO: 1037 | cttccccaaagagaccagt | 2890 | 2909 | 1 | 6 |
| SEQ ID NO: 35 | agaggaagcatgtggcaga | 865 | 884 | SEQ ID NO: 1038 | tctggcatttactttctct | 5921 | 5940 | 1 | 6 |
| SEQ ID NO: 36 | tgaagactctccaggaact | 1087 | 1106 | SEQ ID NO: 1039 | agttgaaggagactattca | 7216 | 7235 | 1 | 6 |
| SEQ ID NO: 37 | ctctgagcaaaatatccag | 1121 | 1140 | SEQ ID NO: 1040 | ctggttactgagctgagag | 1161 | 1180 | 1 | 6 |
| SEQ ID NO: 38 | atgaagcagtcacatctct | 1189 | 1208 | SEQ ID NO: 1041 | agagctgccagtccttcat | 10016 | 10035 | 1 | 6 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 39 | ttgccacagctgattgagg | 1209 | 1228 | SEQ ID NO: 1042 | cctcctacagtggtggcaa | 4222 | 4241 | 1 | 6 |
| SEQ ID NO: 40 | agctgattgaggtgtccag | 1216 | 1235 | SEQ ID NO: 1043 | ctggattccacatgcagct | 11847 | 11866 | 1 | 6 |
| SEQ ID NO: 41 | tgctccactcacatcctcc | 1278 | 1297 | SEQ ID NO: 1044 | ggaggctttaagttcagca | 7601 | 7620 | 1 | 6 |
| SEQ ID NO: 42 | tgaaacgtgtgcatgccaa | 1303 | 1322 | SEQ ID NO: 1045 | ttgggagagacaagtttca | 6500 | 6519 | 1 | 6 |
| SEQ ID NO: 43 | gacattgctaattacctga | 1503 | 1522 | SEQ ID NO: 1046 | tcagaagctaagcaatgtc | 7232 | 7251 | 1 | 6 |
| SEQ ID NO: 44 | ttcttcttcagactttcct | 1738 | 1757 | SEQ ID NO: 1047 | aggagagtccaaattagaa | 8498 | 8517 | 1 | 6 |
| SEQ ID NO: 45 | ccaatatcttgaactcaga | 1903 | 1922 | SEQ ID NO: 1048 | tctgaattcattcaattgg | 6485 | 6504 | 1 | 6 |
| SEQ ID NO: 46 | aaagttagtgaaagaagtt | 1946 | 1965 | SEQ ID NO: 1049 | aactaccctcactgccttt | 2132 | 2151 | 1 | 6 |
| SEQ ID NO: 47 | aagttagtgaaagaagttc | 1947 | 1966 | SEQ ID NO: 1050 | gaacctctggcatttactt | 5916 | 5935 | 1 | 6 |
| SEQ ID NO: 48 | aaagaagttctgaaagaat | 1956 | 1975 | SEQ ID NO: 1051 | attctctggtaactacttt | 5482 | 5501 | 1 | 6 |
| SEQ ID NO: 49 | tttggctataccaaagatg | 2322 | 2341 | SEQ ID NO: 1052 | catcttaggcactgacaaa | 4997 | 5016 | 1 | 6 |
| SEQ ID NO: 50 | tgttgagaagctgattaaa | 2381 | 2400 | SEQ ID NO: 1053 | tttagccatcggctcacca | 5700 | 5719 | 1 | 6 |
| SEQ ID NO: 51 | caggaagggctcaaagaat | 2561 | 2580 | SEQ ID NO: 1054 | attcctttaacaattcctg | 9492 | 9511 | 1 | 6 |
| SEQ ID NO: 52 | aggaagggctcaaagaatg | 2562 | 2581 | SEQ ID NO: 1055 | cattcctttaaccattcct | 9491 | 9510 | 1 | 6 |
| SEQ ID NO: 53 | gaagggctcaaagaatgac | 2564 | 2583 | SEQ ID NO: 1056 | gtcagtcttcaggctcttc | 7914 | 7933 | 1 | 6 |
| SEQ ID NO: 54 | caaagaatgactttttct | 2572 | 2591 | SEQ ID NO: 1057 | agaaggatggcatttttg | 14000 | 14019 | 1 | 6 |
| SEQ ID NO: 55 | catggagaatgcctttgaa | 2603 | 2622 | SEQ ID NO: 1058 | ttcagagccaaagtccatg | 7119 | 7138 | 1 | 6 |
| SEQ ID NO: 56 | ggagccaaggctggagtaa | 2679 | 2698 | SEQ ID NO: 1059 | ttactccaacgccagctcc | 3050 | 3069 | 1 | 6 |
| SEQ ID NO: 57 | tcattccttccccaaagag | 2884 | 2903 | SEQ ID NO: 1060 | ctctctggggcatctatga | 5139 | 5158 | 1 | 6 |
| SEQ ID NO: 58 | acctatgagctccagagag | 3165 | 3184 | SEQ ID NO: 1061 | ctctcaagaccacagaggt | 12976 | 12995 | 1 | 6 |
| SEQ ID NO: 59 | gggcaaaacgtcttacaga | 3365 | 3384 | SEQ ID NO: 1062 | tctgaaagacaacgtgccc | 12317 | 12336 | 1 | 6 |
| SEQ ID NO: 60 | accctggacattcagaaca | 3387 | 3406 | SEQ ID NO: 1063 | tgttgctaaggttcaggt | 5675 | 5694 | 1 | 6 |
| SEQ ID NO: 61 | atgggcgacctacgttgtg | 3429 | 3448 | SEQ ID NO: 1064 | cacaaattagtttcaccat | 8941 | 8960 | 1 | 6 |
| SEQ ID NO: 62 | gatgaagagaagattgaat | 3618 | 3637 | SEQ ID NO: 1065 | attccagcttccccacatc | 8330 | 8349 | 1 | 6 |
| SEQ ID NO: 63 | caatgtagataccaaaaaa | 3656 | 3675 | SEQ ID NO: 1066 | ttttttggaaatgccattg | 8643 | 8662 | 1 | 6 |
| SEQ ID NO: 64 | gtagataccaaaaaaatga | 3660 | 3679 | SEQ ID NO: 1067 | tcatgtgatgggtctctac | 4371 | 4390 | 1 | 6 |
| SEQ ID NO: 65 | gcttcagttcatttggact | 4509 | 4528 | SEQ ID NO: 1068 | agtcaagaaggacttaagc | 5304 | 5323 | 1 | 6 |
| SEQ ID NO: 66 | tttgtttgtcaaagaagtc | 4544 | 4563 | SEQ ID NO: 1069 | gacttcagagaaatacaaa | 11400 | 11419 | 1 | 6 |
| SEQ ID NO: 67 | ttgtttgtcaaagaagtca | 4545 | 4564 | SEQ ID NO: 1070 | tgacttcagagaaatacaa | 11399 | 11418 | 1 | 6 |
| SEQ ID NO: 68 | tggcaatgggaaactcgct | 5846 | 5865 | SEQ ID NO: 1071 | agcgagaatcaccctgcca | 8219 | 8238 | 1 | 6 |
| SEQ ID NO: 69 | aacctctggcatttacttt | 5917 | 5936 | SEQ ID NO: 1072 | aaaggagatgtcaagggtt | 10599 | 10618 | 1 | 6 |
| SEQ ID NO: 70 | catttactttctctcatga | 5926 | 5945 | SEQ ID NO: 1073 | tcatttgaaagaataaatg | 7026 | 7045 | 1 | 6 |
| SEQ ID NO: 71 | aaagtcagtgccctgctta | 6009 | 6028 | SEQ ID NO: 1074 | taagaaccttactgacttt | 7784 | 7803 | 1 | 6 |
| SEQ ID NO: 72 | tcccatttttgagacctt | 6322 | 6341 | SEQ ID NO: 1075 | aaggacttcaggaatggga | 12004 | 12023 | 1 | 6 |
| SEQ ID NO: 73 | catcaatattgatcaattt | 6413 | 6432 | SEQ ID NO: 1076 | aaattaaaaagtcttgatg | 6732 | 6751 | 1 | 6 |
| SEQ ID NO: 74 | taaagatagttatgattta | 6665 | 6684 | SEQ ID NO: 1077 | taaaccaaaacttggttta | 9019 | 9038 | 1 | 6 |
| SEQ ID NO: 75 | tattgatgaaatcattgaa | 6713 | 6732 | SEQ ID NO: 1078 | ttcaaagacttaaaaaata | 8007 | 8026 | 1 | 6 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 76 | atgatctacatttgtttat | 6790 | 6809 | SEQ ID NO: 1079 | ataaagaaattaaagtcat | 7380 | 7399 | 1 | 6 |
| SEQ ID NO: 77 | agagacacatacagaatat | 6919 | 6938 | SEQ ID NO: 1080 | atatattgtcagtgcctct | 13382 | 13401 | 1 | 6 |
| SEQ ID NO: 78 | gacacatacagaatatatga | 6922 | 6941 | SEQ ID NO: 1081 | tctaaattcagttcttgtc | 11327 | 11346 | 1 | 6 |
| SEQ ID NO: 79 | agcatgtcaaacactttgt | 7054 | 7073 | SEQ ID NO: 1082 | acaaagtcagtgccctgct | 6007 | 6026 | 1 | 6 |
| SEQ ID NO: 80 | tttttagaggaaaccaagg | 7515 | 7534 | SEQ ID NO: 1083 | cctttgtgtacaccaaaaa | 11230 | 11249 | 1 | 6 |
| SEQ ID NO: 81 | ttttagaggaaaccaaggc | 7516 | 7535 | SEQ ID NO: 1084 | gcctttgtgtacaccaaaa | 11229 | 11248 | 1 | 6 |
| SEQ ID NO: 82 | ggaagatagacttcctgaa | 9307 | 9326 | SEQ ID NO: 1085 | ttcagaaatactgttttcc | 12824 | 12843 | 1 | 6 |
| SEQ ID NO: 83 | cactgtttctgagtcccag | 9334 | 9353 | SEQ ID NO: 1086 | ctgggacctaccaagagtg | 12523 | 12542 | 1 | 6 |
| SEQ ID NO: 84 | cacaaatcctttggctgtg | 9668 | 9687 | SEQ ID NO: 1087 | cacatttcaaggaattgtg | 10063 | 10082 | 1 | 6 |
| SEQ ID NO: 85 | ttcctggatacactgttcc | 9853 | 9872 | SEQ ID NO: 1088 | ggaactgttgactcaggaa | 12569 | 12588 | 1 | 6 |
| SEQ ID NO: 86 | gaaatctcaagctttctct | 10042 | 10061 | SEQ ID NO: 1089 | agagccaggtcgagctttc | 11044 | 11063 | 1 | 6 |
| SEQ ID NO: 87 | tttcttcatcttcatctgt | 10210 | 10229 | SEQ ID NO: 1090 | acagctgaaagagatgaaa | 13055 | 13074 | 1 | 6 |
| SEQ ID NO: 88 | tctaccgctaaaggagcag | 10521 | 10540 | SEQ ID NO: 1091 | ctgcacgctttgaggtaga | 11761 | 11780 | 1 | 6 |
| SEQ ID NO: 89 | ctaccgctaaaggagcagt | 10522 | 10541 | SEQ ID NO: 1092 | actgcacgctttgaggtag | 11760 | 11779 | 1 | 6 |
| SEQ ID NO: 90 | agggcctcttttcaccaa | 10831 | 10850 | SEQ ID NO: 1093 | ttggccaggaagtggccct | 10957 | 10976 | 1 | 6 |
| SEQ ID NO: 91 | ttctccatccctgtaaaag | 11265 | 11284 | SEQ ID NO: 1094 | cttttcaccaacggagaa | 10838 | 10857 | 1 | 6 |
| SEQ ID NO: 92 | gaaaacaaagcagattat | 11816 | 11835 | SEQ ID NO: 1095 | ataaactgcaagattttc | 13600 | 13619 | 1 | 6 |
| SEQ ID NO: 93 | actcactcattgattttct | 12682 | 12701 | SEQ ID NO: 1096 | agaaaatcaggatctgagt | 14027 | 14046 | 1 | 6 |
| SEQ ID NO: 94 | taaactaatagatgtaatc | 12890 | 12909 | SEQ ID NO: 1097 | gattaccaccagcagttta | 13578 | 13597 | 1 | 6 |
| SEQ ID NO: 95 | caaaacgagcttcaggaag | 13200 | 13219 | SEQ ID NO: 1098 | cttcgtgaagaatattttg | 13260 | 13279 | 1 | 6 |
| SEQ ID NO: 96 | tggaataatgctcagtgtt | 2366 | 2385 | SEQ ID NO: 1099 | aacacttacttgaattcca | 10662 | 10681 | 3 | 5 |
| SEQ ID NO: 97 | gatttgaaatccaaagaag | 2400 | 2419 | SEQ ID NO: 1100 | cttcagagaaatacaaatc | 11402 | 11421 | 3 | 5 |
| SEQ ID NO: 98 | atttgaaatccaaagaagt | 2401 | 2420 | SEQ ID NO: 1101 | acttcagagaaatacaaat | 11401 | 11420 | 3 | 5 |
| SEQ ID NO: 99 | atcaacagccgcttcttg | 990 | 1009 | SEQ ID NO: 1102 | caaagaagtcaagattgat | 4553 | 4572 | 2 | 5 |
| SEQ ID NO: 100 | tgttttgaagactctccag | 1082 | 1101 | SEQ ID NO: 1103 | ctggaaagttaaaacaaca | 6955 | 6974 | 2 | 5 |
| SEQ ID NO: 101 | cccttctgatagatgtggt | 1324 | 1343 | SEQ ID NO: 1104 | accaaagctggcaccaggg | 13961 | 13980 | 2 | 5 |
| SEQ ID NO: 102 | tgagcaagtgaagaacttt | 1868 | 1887 | SEQ ID NO: 1105 | aaagccattcagtctctca | 12963 | 12982 | 2 | 5 |
| SEQ ID NO: 103 | atttgaaatccaaagaagt | 2401 | 2420 | SEQ ID NO: 1106 | acttttctaaacttgaaat | 9055 | 9074 | 2 | 5 |
| SEQ ID NO: 104 | atccaaagaagtcccggaa | 2408 | 2427 | SEQ ID NO: 1107 | ttccggggaaacctgggat | 12721 | 12740 | 2 | 5 |
| SEQ ID NO: 105 | agagcctacctccgcatct | 2430 | 2449 | SEQ ID NO: 1108 | agatggtacgttagcctct | 11921 | 11940 | 2 | 5 |
| SEQ ID NO: 106 | aatgcctttgaactcccca | 2610 | 2629 | SEQ ID NO: 1109 | tgggaactacaatttcatt | 7012 | 7031 | 2 | 5 |
| SEQ ID NO: 107 | gaagtccaaattccggatt | 3297 | 3316 | SEQ ID NO: 1110 | aatcttcaatttattcttc | 13815 | 13834 | 2 | 5 |
| SEQ ID NO: 108 | tgcaagcagaagccagaag | 3496 | 3515 | SEQ ID NO: 1111 | cttcaggttccatcgtgca | 11376 | 11395 | 2 | 5 |
| SEQ ID NO: 109 | gaagagaagattgaatttg | 3621 | 3640 | SEQ ID NO: 1112 | caaaacctactgtctcttc | 10459 | 10478 | 2 | 5 |
| SEQ ID NO: 110 | atgctaaaggcacatatgg | 4597 | 4616 | SEQ ID NO: 1113 | ccatatgaaagtcaagcat | 12656 | 12675 | 2 | 5 |
| SEQ ID NO: 111 | tccctcacctccacctctg | 4737 | 4756 | SEQ ID NO: 1114 | cagattctcagatgaggga | 8912 | 8931 | 2 | 5 |
| SEQ ID NO: 112 | atttacagctctgacaagt | 5427 | 5446 | SEQ ID NO: 1115 | acttttctaaacttgaaat | 9055 | 9074 | 2 | 5 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 113 | aggagcctaccaaaataat | 5594 | 5613 | SEQ ID NO: 1116 | attatgttgaaacagtcct | 11830 | 11849 | 2 | 5 |
| SEQ ID NO: 114 | aaagctgaagcacatcaat | 6401 | 6420 | SEQ ID NO: 1117 | attgttgctcatctccttt | 10194 | 10213 | 2 | 5 |
| SEQ ID NO: 115 | ctgctggaaacaacgagaa | 9418 | 9437 | SEQ ID NO: 1118 | ttctgattaccaccagcag | 13574 | 13593 | 2 | 5 |
| SEQ ID NO: 116 | ttgaaggaattcttgaaaa | 9582 | 9601 | SEQ ID NO: 1119 | ttttaaagaaatcttcaa | 13805 | 13824 | 2 | 5 |
| SEQ ID NO: 117 | gaagtaaaagaaaattttg | 10743 | 10762 | SEQ ID NO: 1120 | caaaacctactgtctcttc | 10459 | 10478 | 2 | 5 |
| SEQ ID NO: 118 | tgaagaagatggcaaattt | 11984 | 12003 | SEQ ID NO: 1121 | aaatgtcagctcttgttca | 10894 | 10913 | 2 | 5 |
| SEQ ID NO: 119 | aggatctgagttattttgc | 14035 | 14054 | SEQ ID NO: 1122 | gcaagtcagcccagttcct | 10920 | 10939 | 2 | 5 |
| SEQ ID NO: 120 | gtgcccttctcggttgctg | 18 | 37 | SEQ ID NO: 1123 | cagccattgacatgagcac | 5740 | 5759 | 1 | 5 |
| SEQ ID NO: 121 | ggcgctgcctgcgctgctg | 146 | 165 | SEQ ID NO: 1124 | cagctccacagactccgcc | 3062 | 3081 | 1 | 5 |
| SEQ ID NO: 122 | ctgcgctgctgctgctgct | 154 | 173 | SEQ ID NO: 1125 | agcagaaggtgcgaagcag | 3224 | 3243 | 1 | 5 |
| SEQ ID NO: 123 | gctgctggcgggcgccagg | 170 | 189 | SEQ ID NO: 1126 | cctggattccacatgcagc | 11846 | 11865 | 1 | 5 |
| SEQ ID NO: 124 | aagaggaaatgctggaaaa | 193 | 212 | SEQ ID NO: 1127 | tttttcttcactacatctt | 2584 | 2603 | 1 | 5 |
| SEQ ID NO: 125 | ctggaaaatgtcagcctgg | 204 | 223 | SEQ ID NO: 1128 | ccagcttccacatcccag | 3915 | 3934 | 1 | 5 |
| SEQ ID NO: 126 | tggagtccctgggactgct | 296 | 315 | SEQ ID NO: 1129 | agcatgcctagtttctcca | 9945 | 9964 | 1 | 5 |
| SEQ ID NO: 127 | ggagtccctgggactgctg | 297 | 316 | SEQ ID NO: 1130 | cagcatgcctagtttctcc | 9944 | 9963 | 1 | 5 |
| SEQ ID NO: 128 | tgggactgctgattcaaga | 305 | 324 | SEQ ID NO: 1131 | tcttccatcacttgaccca | 2042 | 2061 | 1 | 5 |
| SEQ ID NO: 129 | ctgctgattcaagaagtgc | 310 | 329 | SEQ ID NO: 1132 | gcacaccttgacattgcag | 11079 | 11098 | 1 | 5 |
| SEQ ID NO: 130 | tgccaccaggatcaactgc | 326 | 345 | SEQ ID NO: 1133 | gcaggctgaactggtggca | 2717 | 2736 | 1 | 5 |
| SEQ ID NO: 131 | gccaccaggatcaactgca | 327 | 346 | SEQ ID NO: 1134 | tgcaggctgaactggtggc | 2716 | 2735 | 1 | 5 |
| SEQ ID NO: 132 | tgcaaggttgagctggagg | 342 | 361 | SEQ ID NO: 1135 | cctccacctctgatctgca | 4744 | 4763 | 1 | 5 |
| SEQ ID NO: 133 | caaggttgagctggaggtt | 344 | 363 | SEQ ID NO: 1136 | aaccctacatgaagcttg | 13755 | 13774 | 1 | 5 |
| SEQ ID NO: 134 | ctctgcagcttcatcctga | 369 | 388 | SEQ ID NO: 1137 | tcaggaagcttctcaagag | 13211 | 13230 | 1 | 5 |
| SEQ ID NO: 135 | cagcttcatcctgaagacc | 374 | 393 | SEQ ID NO: 1138 | ggtcttgagttaaatgctg | 4977 | 4996 | 1 | 5 |
| SEQ ID NO: 136 | gcttcatcctgaagaccag | 376 | 395 | SEQ ID NO: 1139 | ctggacgctaagaggaagc | 855 | 874 | 1 | 5 |
| SEQ ID NO: 137 | tcatcctgaagaccagcca | 379 | 398 | SEQ ID NO: 1140 | tggcatggcattatgatga | 3604 | 3623 | 1 | 5 |
| SEQ ID NO: 138 | gaaaccaagaactctgag | 452 | 471 | SEQ ID NO: 1141 | ctcaaccttaatgattttc | 8286 | 8305 | 1 | 5 |
| SEQ ID NO: 139 | agaactctgaggagtttgc | 460 | 479 | SEQ ID NO: 1142 | gcaagctatacagtattct | 8377 | 8396 | 1 | 5 |
| SEQ ID NO: 140 | tctgaggagtttgctgcag | 465 | 484 | SEQ ID NO: 1143 | ctgcaggggatcccccaga | 2526 | 2545 | 1 | 5 |
| SEQ ID NO: 141 | tttgctgcagccatgtcca | 474 | 493 | SEQ ID NO: 1144 | tggaagtgtcagtggcaaa | 10372 | 10391 | 1 | 5 |
| SEQ ID NO: 142 | caagaggggcatcatttct | 578 | 597 | SEQ ID NO: 1145 | agaataaatgacgttcttg | 7035 | 7054 | 1 | 5 |
| SEQ ID NO: 143 | tcactttaccgtcaagacg | 674 | 693 | SEQ ID NO: 1146 | cgtctacactatcatgtga | 4360 | 4379 | 1 | 5 |
| SEQ ID NO: 144 | tttaccgtcaagacgagga | 678 | 697 | SEQ ID NO: 1147 | tccttgacatgttgataaa | 7366 | 7385 | 1 | 5 |
| SEQ ID NO: 145 | cactggacgctaagaggaa | 853 | 872 | SEQ ID NO: 1148 | ttccagaaagcagccagtg | 12498 | 12517 | 1 | 5 |
| SEQ ID NO: 146 | aggaagcatgtggcagaag | 867 | 886 | SEQ ID NO: 1149 | cttcatacacattaatcct | 9988 | 10007 | 1 | 5 |
| SEQ ID NO: 147 | caaggagcaacacctcttc | 893 | 912 | SEQ ID NO: 1150 | gaagtagtactgcatcttg | 6835 | 6854 | 1 | 5 |
| SEQ ID NO: 148 | acagactttgaaacttgaa | 959 | 978 | SEQ ID NO: 1151 | ttcaattcttcaatgctgt | 10500 | 10519 | 1 | 5 |
| SEQ ID NO: 149 | tgatgaagcagtcacatct | 1187 | 1206 | SEQ ID NO: 1152 | agatttgaggattccatca | 7976 | 7995 | 1 | 5 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 150 | agcagtcacatctctcttg | 1193 | 1212 | SEQ ID NO: 1153 | caaggagaaactgactgct | 6524 | 6543 | 1 | 5 |
| SEQ ID NO: 151 | ccagccccatcactttaca | 1231 | 1250 | SEQ ID NO: 1154 | tgtagtctcctggtgctgg | 5094 | 5113 | 1 | 5 |
| SEQ ID NO: 152 | ctccactcacatcctccag | 1280 | 1299 | SEQ ID NO: 1155 | ctggagcttagtaatggag | 8709 | 8728 | 1 | 5 |
| SEQ ID NO: 153 | catgccaaccccttctga | 1314 | 1333 | SEQ ID NO: 1156 | tcagatgagggaacacatg | 8919 | 8938 | 1 | 5 |
| SEQ ID NO: 154 | gagagatcttcaacatggc | 1390 | 1409 | SEQ ID NO: 1157 | gccaccctggaactctctc | 10869 | 10888 | 1 | 5 |
| SEQ ID NO: 155 | tcaacatggcgagggatca | 1399 | 1418 | SEQ ID NO: 1158 | tgatcccacctctcattga | 2965 | 2984 | 1 | 5 |
| SEQ ID NO: 156 | ccaccttgtatgcgctgag | 1429 | 1448 | SEQ ID NO: 1159 | ctcagggatctgaaggtgg | 8187 | 8206 | 1 | 5 |
| SEQ ID NO: 157 | gtcaacaactatcataaga | 1455 | 1474 | SEQ ID NO: 1160 | tcttgagttaaatgctgac | 4979 | 4998 | 1 | 5 |
| SEQ ID NO: 158 | tggacattgctaattacct | 1501 | 1520 | SEQ ID NO: 1161 | aggtatattcgaaagtcca | 12799 | 12818 | 1 | 5 |
| SEQ ID NO: 159 | ggacattgctaattacctg | 1502 | 1521 | SEQ ID NO: 1162 | caggtatattcgaaagtcc | 12798 | 12817 | 1 | 5 |
| SEQ ID NO: 160 | ttctgcgggtcattggaaa | 1573 | 1592 | SEQ ID NO: 1163 | tttcacatgccaaggagaa | 6514 | 6533 | 1 | 5 |
| SEQ ID NO: 161 | ccagaactcaagtcttcaa | 1620 | 1639 | SEQ ID NO: 1164 | ttgaagtgtagtctcctgg | 5088 | 5107 | 1 | 5 |
| SEQ ID NO: 162 | agtcttcaatcctgaaatg | 1630 | 1649 | SEQ ID NO: 1165 | catttctgattggtggact | 7757 | 7776 | 1 | 5 |
| SEQ ID NO: 163 | tgagcaagtgaagaacttt | 1868 | 1887 | SEQ ID NO: 1166 | aaagtgccacttttactca | 6183 | 6202 | 1 | 5 |
| SEQ ID NO: 164 | agcaagtgaagaactttgt | 1870 | 1889 | SEQ ID NO: 1167 | acaaagtcagtgccctgct | 6007 | 6026 | 1 | 5 |
| SEQ ID NO: 165 | tctgaaagaatctcaactt | 1964 | 1983 | SEQ ID NO: 1168 | aagtccataatggttcaga | 12811 | 12830 | 1 | 5 |
| SEQ ID NO: 166 | actgtcatggacttcagaa | 1986 | 2005 | SEQ ID NO: 1169 | ttctgaatatattgtcagt | 13376 | 13395 | 1 | 5 |
| SEQ ID NO: 167 | acttgacccagcctcagcc | 2051 | 2070 | SEQ ID NO: 1170 | ggctcaccctgagagaagt | 12391 | 12410 | 1 | 5 |
| SEQ ID NO: 168 | tccaataactaccttcct | 2096 | 2115 | SEQ ID NO: 1171 | aggaagatatgaagatgga | 4712 | 4731 | 1 | 5 |
| SEQ ID NO: 169 | actaccctcactgcctttg | 2133 | 2152 | SEQ ID NO: 1172 | caaatttgtggagggtagt | 10319 | 10338 | 1 | 5 |
| SEQ ID NO: 170 | ttggatttgcttcagctga | 2149 | 2168 | SEQ ID NO: 1173 | tcagtataagtacaaccaa | 9392 | 9411 | 1 | 5 |
| SEQ ID NO: 171 | ttggaagctcttttggga | 2211 | 2230 | SEQ ID NO: 1174 | tcccgattcacgcttccaa | 11577 | 11596 | 1 | 5 |
| SEQ ID NO: 172 | ggaagctcttttgggaag | 2213 | 2232 | SEQ ID NO: 1175 | cttcagaaagctaccttcc | 7929 | 7948 | 1 | 5 |
| SEQ ID NO: 173 | tttttcccagacagtgtca | 2238 | 2257 | SEQ ID NO: 1176 | tgaccttctctaagcaaaa | 4876 | 4895 | 1 | 5 |
| SEQ ID NO: 174 | agacagtgtcaacaaagct | 2246 | 2265 | SEQ ID NO: 1177 | agcttggttttgccagtct | 2458 | 2477 | 1 | 5 |
| SEQ ID NO: 175 | ctttggctataccaaagat | 2321 | 2340 | SEQ ID NO: 1178 | atctcgtgtctaggaaaag | 5968 | 5987 | 1 | 5 |
| SEQ ID NO: 176 | caaagatgataaacatgag | 2333 | 2352 | SEQ ID NO: 1179 | ctcaaggataacgtgtttg | 12609 | 12628 | 1 | 5 |
| SEQ ID NO: 177 | gatatggtaaatggaataa | 2355 | 2374 | SEQ ID NO: 1180 | ttatcttattaattatatc | 13079 | 13098 | 1 | 5 |
| SEQ ID NO: 178 | ggaataatgctcagtgttg | 2367 | 2386 | SEQ ID NO: 1181 | caacacttacttgaattcc | 10661 | 10680 | 1 | 5 |
| SEQ ID NO: 179 | tttgaaatccaaagaagtc | 2402 | 2421 | SEQ ID NO: 1182 | gacttcagagaaatacaaa | 11400 | 11419 | 1 | 5 |
| SEQ ID NO: 180 | gatccccagatgattgga | 2534 | 2553 | SEQ ID NO: 1183 | tccaatttccctgtggatc | 3681 | 3700 | 1 | 5 |
| SEQ ID NO: 181 | cagatgattggagaggtca | 2541 | 2560 | SEQ ID NO: 1184 | tgaccacacaaacagtctg | 5363 | 5382 | 1 | 5 |
| SEQ ID NO: 182 | agaatgacttttttcttca | 2575 | 2594 | SEQ ID NO: 1185 | tgaagtccggattcattct | 11015 | 11034 | 1 | 5 |
| SEQ ID NO: 183 | gaactcccactggagctg | 2619 | 2638 | SEQ ID NO: 1186 | cagctcaaccgtacagttc | 11861 | 11880 | 1 | 5 |
| SEQ ID NO: 184 | atatcttcatctggagtca | 2652 | 2671 | SEQ ID NO: 1187 | tgacttcagtgcagaatat | 11966 | 11985 | 1 | 5 |
| SEQ ID NO: 185 | gtcattgctcccggagcca | 2667 | 2686 | SEQ ID NO: 1188 | tggccccgttaccatgac | 5809 | 5828 | 1 | 5 |
| SEQ ID NO: 186 | gctgaagtttatcattcct | 2873 | 2892 | SEQ ID NO: 1189 | aggagctttaagttcagc | 7600 | 7619 | 1 | 5 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 187 | attccttccccaaagagac | 2886 | 2905 | SEQ ID NO: 1190 | gtctcttcctccatggaat | 10470 | 10489 | 1 | 5 |
| SEQ ID NO: 188 | ctcattgagaacaggcagt | 2976 | 2995 | SEQ ID NO: 1191 | actgactgcacgctttgag | 11756 | 11775 | 1 | 5 |
| SEQ ID NO: 189 | ttgagcagtattctgtcag | 3142 | 3161 | SEQ ID NO: 1192 | ctgagagaagtgtcttcaa | 12399 | 12418 | 1 | 5 |
| SEQ ID NO: 190 | accttgtccagtgaagtcc | 3285 | 3304 | SEQ ID NO: 1193 | ggacggtactgtcccaggt | 12784 | 12803 | 1 | 5 |
| SEQ ID NO: 191 | ccagtgaagtccaaattcc | 3292 | 3311 | SEQ ID NO: 1194 | ggaaggcagagtttactgg | 9148 | 9167 | 1 | 5 |
| SEQ ID NO: 192 | acattcagaacaagaaaat | 3394 | 3413 | SEQ ID NO: 1195 | atttcctaaagctggatgt | 11167 | 11186 | 1 | 5 |
| SEQ ID NO: 193 | gaaaaatcaagggtgttat | 3463 | 3482 | SEQ ID NO: 1196 | ataaactgcaagattttc | 13600 | 13619 | 1 | 5 |
| SEQ ID NO: 194 | aaatcaagggtgttatttc | 3466 | 3485 | SEQ ID NO: 1197 | gaaacaatgcattagattt | 9745 | 9764 | 1 | 5 |
| SEQ ID NO: 195 | tggcattatgatgaagaga | 3609 | 3628 | SEQ ID NO: 1198 | tctcccgtgtataatgcca | 11781 | 11800 | 1 | 5 |
| SEQ ID NO: 196 | aagagaagattgaatttga | 3622 | 3641 | SEQ ID NO: 1199 | tcaaaacctactgtctctt | 10458 | 10477 | 1 | 5 |
| SEQ ID NO: 197 | aaatgacttccaatttccc | 3673 | 3692 | SEQ ID NO: 1200 | gggaactacaatttcattt | 7013 | 7032 | 1 | 5 |
| SEQ ID NO: 198 | atgacttccaatttccctg | 3675 | 3694 | SEQ ID NO: 1201 | caggctgattacgagtcat | 4917 | 4936 | 1 | 5 |
| SEQ ID NO: 199 | acttccaatttccctgtgg | 3678 | 3697 | SEQ ID NO: 1202 | ccacgaaaaatatgcaagt | 10360 | 10379 | 1 | 5 |
| SEQ ID NO: 200 | agttgcaatgagctcatgg | 3803 | 3822 | SEQ ID NO: 1203 | ccatcagttcagataaact | 7989 | 8008 | 1 | 5 |
| SEQ ID NO: 201 | tttgcaagaccacctcaat | 3860 | 3879 | SEQ ID NO: 1204 | attgacctgtccattcaaa | 13671 | 13690 | 1 | 5 |
| SEQ ID NO: 202 | gaaggagttcaacctccag | 3884 | 3903 | SEQ ID NO: 1205 | ctggaattgtcattccttc | 11728 | 11747 | 1 | 5 |
| SEQ ID NO: 203 | acttccacatcccagaaaa | 3919 | 3938 | SEQ ID NO: 1206 | ttttaacaaaagtggaagt | 6821 | 6840 | 1 | 5 |
| SEQ ID NO: 204 | ctcttcttaaaaagcgatg | 3939 | 3958 | SEQ ID NO: 1207 | catcactgccaaaggagag | 8486 | 8505 | 1 | 5 |
| SEQ ID NO: 205 | aaaagcgatggccgggtca | 3948 | 3967 | SEQ ID NO: 1208 | tgactcactcattgatttt | 12680 | 12699 | 1 | 5 |
| SEQ ID NO: 206 | ttcctttgccttttggtgg | 4003 | 4022 | SEQ ID NO: 1209 | ccacaaacaatgaagggaa | 9256 | 9275 | 1 | 5 |
| SEQ ID NO: 207 | caagtctgtgggattccat | 4079 | 4098 | SEQ ID NO: 1210 | atgggaaaaacaggcttg | 9566 | 9585 | 1 | 5 |
| SEQ ID NO: 208 | aagtccctacttttaccat | 4117 | 4136 | SEQ ID NO: 1211 | atgggaagtataagaactt | 4834 | 4853 | 1 | 5 |
| SEQ ID NO: 209 | tgcctctcctgggtgttct | 4159 | 4178 | SEQ ID NO: 1212 | agaaaaacaaacacaggca | 9643 | 9662 | 1 | 5 |
| SEQ ID NO: 210 | accagcacagaccatttca | 4242 | 4261 | SEQ ID NO: 1213 | tgaagtgtagtctcctggt | 5089 | 5108 | 1 | 5 |
| SEQ ID NO: 211 | ccagcacagaccatttcag | 4243 | 4262 | SEQ ID NO: 1214 | ctgaaatacaatgctctgg | 5511 | 5530 | 1 | 5 |
| SEQ ID NO: 212 | actatcatgtgatgggtct | 4367 | 4386 | SEQ ID NO: 1215 | agacacctgattttatagt | 7948 | 7967 | 1 | 5 |
| SEQ ID NO: 213 | accacagatgtctgcttca | 4496 | 4515 | SEQ ID NO: 1216 | tgaaggctgactctgtggt | 4282 | 4301 | 1 | 5 |
| SEQ ID NO: 214 | ccacagatgtctgcttcag | 4497 | 4516 | SEQ ID NO: 1217 | ctgagcaacaaatttgtgg | 10311 | 10330 | 1 | 5 |
| SEQ ID NO: 215 | tttggactccaaaaagaaa | 4520 | 4539 | SEQ ID NO: 1218 | tttctctcatgattacaaa | 5933 | 5952 | 1 | 5 |
| SEQ ID NO: 216 | tcaaagaagtcaagattga | 4552 | 4571 | SEQ ID NO: 1219 | tcaaggataacgtgtttga | 12610 | 12629 | 1 | 5 |
| SEQ ID NO: 217 | atgagaactacgagctgac | 4798 | 4817 | SEQ ID NO: 1220 | gtcagatattgttgctcat | 10187 | 10206 | 1 | 5 |
| SEQ ID NO: 218 | ttaaaatctgacaccaatg | 4818 | 4837 | SEQ ID NO: 1221 | cattcattgaagatgttaa | 7342 | 7361 | 1 | 5 |
| SEQ ID NO: 219 | gaagtataagaactttgcc | 4838 | 4857 | SEQ ID NO: 1222 | ggcaaatttgaaggacttc | 11994 | 12013 | 1 | 5 |
| SEQ ID NO: 220 | aagtataagaactttgcca | 4839 | 4858 | SEQ ID NO: 1223 | tggcaaatttgaaggactt | 11993 | 12012 | 1 | 5 |
| SEQ ID NO: 221 | ttcttcagcctgctttctg | 4941 | 4960 | SEQ ID NO: 1224 | cagaatccagatacaagaa | 6884 | 6903 | 1 | 5 |
| SEQ ID NO: 222 | ctggatcactaaattccca | 4957 | 4976 | SEQ ID NO: 1225 | tgggtctttccagagccag | 11033 | 11052 | 1 | 5 |
| SEQ ID NO: 223 | aaattaatagtggtgctca | 5014 | 5033 | SEQ ID NO: 1226 | tgagaagccccaagaattt | 6248 | 6267 | 1 | 5 |

TABLE 8-continued

Selected palindromic sequences from human ApoB

| | Source | Start Index | End Index | Match | Start Index | End Index | # | B |
|---|---|---|---|---|---|---|---|---|
| SEQ ID NO: 224 | agtgcaacgaccaacttga | 5073 | 5092 | SEQ ID NO: 1227 | tcaaattcctggatacact | 9848 | 9867 | 1 | 5 |
| SEQ ID NO: 225 | ctgggaagtgcttatcagg | 5238 | 5257 | SEQ ID NO: 1228 | cctgaccttcacataccag | 8310 | 8329 | 1 | 5 |
| SEQ ID NO: 226 | gcaaaaacatttcaactt | 5278 | 5297 | SEQ ID NO: 1229 | aagtaaaagaaaattttgc | 10744 | 10763 | 1 | 5 |
| SEQ ID NO: 227 | aaaaacattttcaacttca | 5280 | 5299 | SEQ ID NO: 1230 | tgaagtaaaagaaaatttt | 10742 | 10761 | 1 | 5 |
| SEQ ID NO: 228 | tcagtcaagaaggacttaa | 5302 | 5321 | SEQ ID NO: 1231 | ttaaggacttccattctga | 13363 | 13382 | 1 | 5 |
| SEQ ID NO: 229 | tcaaatgacatgatgggct | 5325 | 5344 | SEQ ID NO: 1232 | agcccatcaatatcattga | 6205 | 6224 | 1 | 5 |
| SEQ ID NO: 230 | cacacaaacagtctgaaca | 5367 | 5386 | SEQ ID NO: 1233 | tgtttcaactgcctttgtg | 11219 | 11238 | 1 | 5 |
| SEQ ID NO: 231 | tcttcaaaacttgacaaca | 5409 | 5428 | SEQ ID NO: 1234 | tgttttcctatttccaaga | 12835 | 12854 | 1 | 5 |
| SEQ ID NO: 232 | caagttttataagcaaact | 5441 | 5460 | SEQ ID NO: 1235 | agttattttgctaaacttg | 14043 | 14062 | 1 | 5 |
| SEQ ID NO: 233 | tggtaactactttaaacag | 5488 | 5507 | SEQ ID NO: 1236 | ctgtttttagaggaaacca | 7512 | 7531 | 1 | 5 |
| SEQ ID NO: 234 | aacagtgacctgaaataca | 5502 | 5521 | SEQ ID NO: 1237 | tgtatagcaaattcctgtt | 5890 | 5909 | 1 | 5 |
| SEQ ID NO: 235 | gggaaactacggctagaac | 5544 | 5563 | SEQ ID NO: 1238 | gttccttccatgatttccc | 10933 | 10952 | 1 | 5 |
| SEQ ID NO: 236 | aacacatctatgccatctc | 5620 | 5639 | SEQ ID NO: 1239 | gagacagcatcttcgtgtt | 11204 | 11223 | 1 | 5 |
| SEQ ID NO: 237 | tcagcaagctataaagcag | 5652 | 5671 | SEQ ID NO: 1240 | ctgctaagaaccttactga | 7780 | 7799 | 1 | 5 |
| SEQ ID NO: 238 | gcagacactgttgctaagg | 5667 | 5686 | SEQ ID NO: 1241 | cctttcaagcactgactgc | 11746 | 11765 | 1 | 5 |
| SEQ ID NO: 239 | tctggggagaacatactgg | 5866 | 5885 | SEQ ID NO: 1242 | ccaggttttccacaccaga | 8038 | 8057 | 1 | 5 |
| SEQ ID NO: 240 | ttctctcatgattacaaag | 5934 | 5953 | SEQ ID NO: 1243 | cttttcaccaacggagaa | 10838 | 10857 | 1 | 5 |
| SEQ ID NO: 241 | ctgagcagacaggcacctg | 6034 | 6053 | SEQ ID NO: 1244 | caggaggctttaagttcag | 7599 | 7618 | 1 | 5 |
| SEQ ID NO: 242 | caatttaacaacaatgaat | 6066 | 6085 | SEQ ID NO: 1245 | attccttcctttacaattg | 8082 | 8101 | 1 | 5 |
| SEQ ID NO: 243 | tggacgaactctggctgac | 6140 | 6159 | SEQ ID NO: 1246 | gtcagcccagttccttcca | 10924 | 10943 | 1 | 5 |
| SEQ ID NO: 244 | cttttactcagtgagccca | 6192 | 6211 | SEQ ID NO: 1247 | tgggctaaacgtatgaaag | 7827 | 7846 | 1 | 5 |
| SEQ ID NO: 245 | tcattgatgctttagagat | 6217 | 6236 | SEQ ID NO: 1248 | atcttcataagttcaatga | 13174 | 13193 | 1 | 5 |
| SEQ ID NO: 246 | aaaaccaagatgttcactc | 6295 | 6314 | SEQ ID NO: 1249 | gagtgaaatgctgtttttt | 8630 | 8649 | 1 | 5 |
| SEQ ID NO: 247 | aggaatcgacaaaccatta | 6357 | 6376 | SEQ ID NO: 1250 | taatgattttcaagttcct | 8294 | 8313 | 1 | 5 |
| SEQ ID NO: 248 | tagttgtactggaaaacgt | 6376 | 6395 | SEQ ID NO: 1251 | acgttagcctctaagacta | 11928 | 11947 | 1 | 5 |
| SEQ ID NO: 249 | ggaaacgtacagagaaag | 6386 | 6405 | SEQ ID NO: 1252 | cttttacaattcatttcc | 13014 | 13033 | 1 | 5 |
| SEQ ID NO: 250 | gaaaacgtacagagaaagc | 6387 | 6406 | SEQ ID NO: 1253 | gctttctcttccacatttc | 10052 | 10071 | 1 | 5 |
| SEQ ID NO: 251 | aaagctgaagcacatcaat | 6401 | 6420 | SEQ ID NO: 1254 | attgatgttagagtgcttt | 6984 | 7003 | 1 | 5 |
| SEQ ID NO: 252 | aagctgaagcacatcaata | 6402 | 6421 | SEQ ID NO: 1255 | tattgatgttagagtgctt | 6983 | 7002 | 1 | 5 |
| SEQ ID NO: 253 | tgaagcacatcaataattga | 6406 | 6425 | SEQ ID NO: 1256 | tcaaccttaatgattttca | 8287 | 8306 | 1 | 5 |
| SEQ ID NO: 254 | atcaatattgatcaatttg | 6414 | 6433 | SEQ ID NO: 1257 | caaagccatcactgatgat | 1660 | 1679 | 1 | 5 |
| SEQ ID NO: 255 | taatgattatctgaattca | 6476 | 6495 | SEQ ID NO: 1258 | tgaaatcattgaaaatta | 6719 | 6738 | 1 | 5 |
| SEQ ID NO: 256 | gattatctgaattcattca | 6480 | 6499 | SEQ ID NO: 1259 | tgaagtagctgagaaaatc | 7094 | 7113 | 1 | 5 |
| SEQ ID NO: 257 | aattgggagagacaagttt | 6498 | 6517 | SEQ ID NO: 1260 | aaacattcctttaacaatt | 9488 | 9507 | 1 | 5 |
| SEQ ID NO: 258 | aaaatagctattgctaata | 6693 | 6712 | SEQ ID NO: 1261 | tattgaaaatattgattt | 6806 | 6825 | 1 | 5 |
| SEQ ID NO: 259 | aaaattaaaaagtcttgat | 6731 | 6750 | SEQ ID NO: 1262 | atcatatccgtgtaattt | 6757 | 6776 | 1 | 5 |
| SEQ ID NO: 260 | ttgaaaatattgattttaa | 6808 | 6827 | SEQ ID NO: 1263 | ttaatcttcataagttcaa | 13171 | 13190 | 1 | 5 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 261 | agacatccagcacctagct | 6938 | 6957 | SEQ ID NO: 1264 | agcttggttttgccagtct | 2458 | 2477 | 1 | 5 |
| SEQ ID NO: 262 | caatttcatttgaaagaat | 7021 | 7040 | SEQ ID NO: 1265 | attccttcctttacaattg | 8082 | 8101 | 1 | 5 |
| SEQ ID NO: 263 | aggttttaatggataaatt | 7174 | 7193 | SEQ ID NO: 1266 | aattgttgaaagaaaacct | 13147 | 13166 | 1 | 5 |
| SEQ ID NO: 264 | cagaagctaagcaatgtcc | 7233 | 7252 | SEQ ID NO: 1267 | ggacaaggcccagaatctg | 12545 | 12564 | 1 | 5 |
| SEQ ID NO: 265 | taagataaaagattacttt | 7262 | 7281 | SEQ ID NO: 1268 | aaagaaaacctatgcctta | 13155 | 13174 | 1 | 5 |
| SEQ ID NO: 266 | aaagattactttgagaaat | 7269 | 7288 | SEQ ID NO: 1269 | atttcttaaacattccttt | 9481 | 9500 | 1 | 5 |
| SEQ ID NO: 267 | gagaaattagttggattta | 7281 | 7300 | SEQ ID NO: 1270 | taaagccattcagtctctc | 12962 | 12981 | 1 | 5 |
| SEQ ID NO: 268 | atttattgatgatgctgtc | 7295 | 7314 | SEQ ID NO: 1271 | gacatgttgataaagaaat | 7371 | 7390 | 1 | 5 |
| SEQ ID NO: 269 | gaattatcttttaaaacat | 7326 | 7345 | SEQ ID NO: 1272 | atgtatcaaatggacattc | 7677 | 7696 | 1 | 5 |
| SEQ ID NO: 270 | ttaccaccagtttgtagat | 7403 | 7422 | SEQ ID NO: 1273 | atctggaaccttgaagtaa | 10731 | 10750 | 1 | 5 |
| SEQ ID NO: 271 | ttgcagtgtatctggaaag | 7540 | 7559 | SEQ ID NO: 1274 | cttttcacattagatgcaa | 8412 | 8431 | 1 | 5 |
| SEQ ID NO: 272 | cattcagcaggaacttcaa | 7691 | 7710 | SEQ ID NO: 1275 | ttgaaggacttcaggaatg | 12001 | 12020 | 1 | 5 |
| SEQ ID NO: 273 | acacctgattttatagtcc | 7950 | 7969 | SEQ ID NO: 1276 | ggactcaaggataacgtgt | 12606 | 12625 | 1 | 5 |
| SEQ ID NO: 274 | ggattccatcagttcagat | 7984 | 8003 | SEQ ID NO: 1277 | atcttcaatgattatatcc | 13116 | 13135 | 1 | 5 |
| SEQ ID NO: 275 | ttgtagaaatgaaagtaaa | 8104 | 8123 | SEQ ID NO: 1278 | tttatgattatgtcaacaa | 12352 | 12371 | 1 | 5 |
| SEQ ID NO: 276 | ctgaacagtgagctgcagt | 8148 | 8167 | SEQ ID NO: 1279 | actggacttctctagtcag | 8801 | 8820 | 1 | 5 |
| SEQ ID NO: 277 | aatccaatctcctctttc | 8399 | 8418 | SEQ ID NO: 1280 | gaaaaatgaagtccggatt | 11009 | 11028 | 1 | 5 |
| SEQ ID NO: 278 | attttgattttcaagcaaa | 8524 | 8543 | SEQ ID NO: 1281 | tttgcaagttaaagaaaat | 14015 | 14034 | 1 | 5 |
| SEQ ID NO: 279 | ttttgattttcaagcaaat | 8525 | 8544 | SEQ ID NO: 1282 | atttgatttaagtgtaaaa | 9614 | 9633 | 1 | 5 |
| SEQ ID NO: 280 | tgattttcaagcaaatgca | 8528 | 8547 | SEQ ID NO: 1283 | tgcaagttaaagaaaatca | 14017 | 14036 | 1 | 5 |
| SEQ ID NO: 281 | atgctgtttttggaaatg | 8637 | 8656 | SEQ ID NO: 1284 | cattggtaggagacagcat | 11195 | 11214 | 1 | 5 |
| SEQ ID NO: 282 | tgctgtttttggaaatgc | 8638 | 8657 | SEQ ID NO: 1285 | gcattggtaggagacagca | 11194 | 11213 | 1 | 5 |
| SEQ ID NO: 283 | aaaaaatacactggagct | 8698 | 8717 | SEQ ID NO: 1286 | agctagagggcctctttt | 10825 | 10844 | 1 | 5 |
| SEQ ID NO: 284 | actggagcttagtaatgga | 8708 | 8727 | SEQ ID NO: 1287 | tccactcacatcctccagt | 1281 | 1300 | 1 | 5 |
| SEQ ID NO: 285 | cttctggaaaagggtcatg | 8878 | 8897 | SEQ ID NO: 1288 | catgaaccctacatgaag | 13751 | 13770 | 1 | 5 |
| SEQ ID NO: 286 | ggaaaagggtcatggaaat | 8883 | 8902 | SEQ ID NO: 1289 | atttgaaagttcgttttcc | 9274 | 9293 | 1 | 5 |
| SEQ ID NO: 287 | gggcctgccccagattctc | 8902 | 8921 | SEQ ID NO: 1290 | gagaacattatggaggccc | 9432 | 9451 | 1 | 5 |
| SEQ ID NO: 288 | ttctcagatgagggaacac | 8916 | 8935 | SEQ ID NO: 1291 | gtgtcttcaaagctgagaa | 12408 | 12427 | 1 | 5 |
| SEQ ID NO: 289 | gatgagggaacacatgaat | 8922 | 8941 | SEQ ID NO: 1292 | attccagcttccccacatc | 8330 | 8349 | 1 | 5 |
| SEQ ID NO: 290 | ctttggactgtccaataag | 8978 | 8997 | SEQ ID NO: 1293 | cttatgggatttcctaaag | 11159 | 11178 | 1 | 5 |
| SEQ ID NO: 291 | gcatccacaaacaatgaag | 9252 | 9271 | SEQ ID NO: 1294 | cttcatctgtcattgatgc | 10219 | 10238 | 1 | 5 |
| SEQ ID NO: 292 | cacaaacaatgaagggaat | 9257 | 9276 | SEQ ID NO: 1295 | attccctgaagttgatgtg | 11480 | 11499 | 1 | 5 |
| SEQ ID NO: 293 | ccaaaatttctctgctgga | 9407 | 9426 | SEQ ID NO: 1296 | tccatcacaaatcctttgg | 9663 | 9682 | 1 | 5 |
| SEQ ID NO: 294 | caaaatttctctgctggaa | 9408 | 9427 | SEQ ID NO: 1297 | ttccatcacaaatcctttg | 9662 | 9681 | 1 | 5 |
| SEQ ID NO: 295 | tctgctggaaacaacgaga | 9417 | 9436 | SEQ ID NO: 1298 | tctcaagagttacagcaga | 13221 | 13240 | 1 | 5 |
| SEQ ID NO: 296 | ctgctggaaacaacgagaa | 9418 | 9437 | SEQ ID NO: 1299 | ttctcaagagttacagcag | 13220 | 13239 | 1 | 5 |
| SEQ ID NO: 297 | agaacattatggaggccca | 9433 | 9452 | SEQ ID NO: 1300 | tgggcctgccccagattct | 8901 | 8920 | 1 | 5 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 298 | agaagcaaatctggatttc | 9467 | 9486 | SEQ ID NO: 1301 | gaaatcttcaatttattct | 13813 | 13832 | 1 | 5 |
| SEQ ID NO: 299 | tttctctctatgggaaaaa | 9557 | 9576 | SEQ ID NO: 1302 | tttttgcaagttaaagaaa | 14013 | 14032 | 1 | 5 |
| SEQ ID NO: 300 | tcagagcatcaaatccttt | 9704 | 9723 | SEQ ID NO: 1303 | aaagaaaatcaggatctga | 14025 | 14044 | 1 | 5 |
| SEQ ID NO: 301 | cagaaacaatgcattagat | 9743 | 9762 | SEQ ID NO: 1304 | atctatgccatctcttctg | 5625 | 5644 | 1 | 5 |
| SEQ ID NO: 302 | tacacattaatcctgccat | 9993 | 10012 | SEQ ID NO: 1305 | atggagtctttattgtgta | 14081 | 14100 | 1 | 5 |
| SEQ ID NO: 303 | agtcagatattgttgctca | 10186 | 10205 | SEQ ID NO: 1306 | tgagaactacgagctgact | 4799 | 4818 | 1 | 5 |
| SEQ ID NO: 304 | ggagggtagtcataacagt | 10328 | 10347 | SEQ ID NO: 1307 | actggtggcaaaaccctcc | 2726 | 2745 | 1 | 5 |
| SEQ ID NO: 305 | caaaagccgaaattccaat | 10396 | 10415 | SEQ ID NO: 1308 | attgaagtacctactttg | 8358 | 8377 | 1 | 5 |
| SEQ ID NO: 306 | aaaagccgaaattccaatt | 10397 | 10416 | SEQ ID NO: 1309 | aattgaagtacctacttt | 8357 | 8376 | 1 | 5 |
| SEQ ID NO: 307 | ttcaagcaagaacttaatg | 10428 | 10447 | SEQ ID NO: 1310 | cattatggcccttcgtgaa | 13250 | 13269 | 1 | 5 |
| SEQ ID NO: 308 | cctcttacttttccattga | 10570 | 10589 | SEQ ID NO: 1311 | tcaaaagaagcccaagagg | 12939 | 12958 | 1 | 5 |
| SEQ ID NO: 309 | tgaggccaacacttacttg | 10655 | 10674 | SEQ ID NO: 1312 | caagcatctgattgactca | 12668 | 12687 | 1 | 5 |
| SEQ ID NO: 310 | cacttacttgaattccaag | 10664 | 10683 | SEQ ID NO: 1313 | cttgaacacaaagtcagtg | 6000 | 6019 | 1 | 5 |
| SEQ ID NO: 311 | gaagtaaaagaaaattttg | 10743 | 10762 | SEQ ID NO: 1314 | caaaaacattttcaacttc | 5279 | 5298 | 1 | 5 |
| SEQ ID NO: 312 | cctggaactctctccatgg | 10874 | 10893 | SEQ ID NO: 1315 | ccatttacagatcttcagg | 11364 | 11383 | 1 | 5 |
| SEQ ID NO: 313 | agctggatgtaaccaccag | 11176 | 11195 | SEQ ID NO: 1316 | ctggattccacatgcagct | 11847 | 11866 | 1 | 5 |
| SEQ ID NO: 314 | aaaattccctgaagttgat | 11477 | 11496 | SEQ ID NO: 1317 | atcatatccgtgtaatttt | 6757 | 6776 | 1 | 5 |
| SEQ ID NO: 315 | cagatggcattgctgcttt | 11605 | 11624 | SEQ ID NO: 1318 | aaagctgagaagaaatctg | 12416 | 12435 | 1 | 5 |
| SEQ ID NO: 316 | agatggcattgctgctttg | 11606 | 11625 | SEQ ID NO: 1319 | caaagctgagaagaaatct | 12415 | 12434 | 1 | 5 |
| SEQ ID NO: 317 | tgttgaaacagtcctggat | 11834 | 11853 | SEQ ID NO: 1320 | atccaagatgagatcaaca | 13095 | 13114 | 1 | 5 |
| SEQ ID NO: 318 | catattcaaaactgagttg | 12221 | 12240 | SEQ ID NO: 1321 | caactctctgattactatg | 13623 | 13642 | 1 | 5 |
| SEQ ID NO: 319 | aaagatttatcaaaagaag | 12930 | 12949 | SEQ ID NO: 1322 | cttcaatttattcttcttt | 13818 | 13837 | 1 | 5 |
| SEQ ID NO: 320 | attttccaactaatagaag | 13026 | 13045 | SEQ ID NO: 1323 | cttcaaagacttaaaaaat | 8006 | 8025 | 1 | 5 |
| SEQ ID NO: 321 | aattatatccaagatgaga | 13089 | 13108 | SEQ ID NO: 1324 | tctcttcctccatggaatt | 10471 | 10490 | 1 | 5 |
| SEQ ID NO: 322 | ttcaggaagcttctcaaga | 13210 | 13229 | SEQ ID NO: 1325 | tcttcataagttcaatgaa | 13175 | 13194 | 1 | 5 |
| SEQ ID NO: 323 | ttgagcaatttctgcacag | 13429 | 13448 | SEQ ID NO: 1326 | ctgttgaaagatttatcaa | 12924 | 12943 | 1 | 5 |
| SEQ ID NO: 324 | ctgatatacatcacggagt | 13704 | 13723 | SEQ ID NO: 1327 | actcaatggtgaaattcag | 7457 | 7476 | 1 | 5 |
| SEQ ID NO: 325 | acatcacggagttactgaa | 13711 | 13730 | SEQ ID NO: 1328 | ttcagaagctaagcaatgt | 7231 | 7250 | 1 | 5 |
| SEQ ID NO: 326 | actgcctatattgataaaa | 13874 | 13893 | SEQ ID NO: 1329 | ttttggcaagctatacagt | 8372 | 8391 | 1 | 5 |
| SEQ ID NO: 327 | aggatggcatttttgcaa | 14003 | 14022 | SEQ ID NO: 1330 | ttgcaagcaagtctttcct | 3005 | 3024 | 1 | 5 |
| SEQ ID NO: 328 | tttttgcaagttaaagaa | 14012 | 14031 | SEQ ID NO: 1331 | ttctctctatgggaaaaa | 9558 | 9577 | 1 | 5 |
| SEQ ID NO: 329 | tccagaactcaagtcttca | 1619 | 1638 | SEQ ID NO: 1332 | tgaaatgctgttttttgga | 8633 | 8652 | 3 | 4 |
| SEQ ID NO: 330 | agttagtgaaagaagttct | 1948 | 1967 | SEQ ID NO: 1333 | agaatctgtaccaggaact | 12556 | 12575 | 3 | 4 |
| SEQ ID NO: 331 | atttacagctctgacaagt | 5427 | 5446 | SEQ ID NO: 1334 | acttcagagaaatacaaat | 11401 | 11420 | 3 | 4 |
| SEQ ID NO: 332 | gattatctgaattcattca | 6480 | 6499 | SEQ ID NO: 1335 | tgaaccaatgacaaaatc | 7421 | 7440 | 3 | 4 |
| SEQ ID NO: 333 | gtgcccttctcggttgctg | 18 | 37 | SEQ ID NO: 1336 | cagctgagcagacaggcac | 6031 | 6050 | 2 | 4 |
| SEQ ID NO: 334 | attcaagcacctccggaag | 245 | 264 | SEQ ID NO: 1337 | cttcataagttcaatgaat | 13176 | 13195 | 2 | 4 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 335 | gactgctgattcaagaagt | 308 | 327 | SEQ ID NO: 1338 | acttcccaactctcaagtc | 13407 | 13426 | 2 | 4 |
| SEQ ID NO: 336 | ttgctgcagccatgtccag | 475 | 494 | SEQ ID NO: 1339 | ctgggcagctgtatagcaa | 5881 | 5900 | 2 | 4 |
| SEQ ID NO: 337 | agaaagatgaacctactta | 547 | 566 | SEQ ID NO: 1340 | taagtatgatttcaattct | 10490 | 10509 | 2 | 4 |
| SEQ ID NO: 338 | tgaagactctccaggaact | 1087 | 1105 | SEQ ID NO: 1341 | agttcaatgaatttattca | 13183 | 13202 | 2 | 4 |
| SEQ ID NO: 339 | atctctcttgccacagctg | 1202 | 1221 | SEQ ID NO: 1342 | cagcccagccatttgagat | 9229 | 9248 | 2 | 4 |
| SEQ ID NO: 340 | tctctcttgccacagctga | 1203 | 1222 | SEQ ID NO: 1343 | tcagcccagccatttgaga | 9228 | 9247 | 2 | 4 |
| SEQ ID NO: 341 | tgaggtgtccagccccatc | 1223 | 1242 | SEQ ID NO: 1344 | gatgggaaagccgccctca | 5208 | 5227 | 2 | 4 |
| SEQ ID NO: 342 | ccagaactcaagtcttcaa | 1620 | 1639 | SEQ ID NO: 1345 | ttgaaagcagaacctctgg | 5907 | 5926 | 2 | 4 |
| SEQ ID NO: 343 | ctgaaaaagttagtgaaag | 1941 | 1960 | SEQ ID NO: 1346 | ctttctcgggaatattcag | 10623 | 10642 | 2 | 4 |
| SEQ ID NO: 344 | tttttcccagacagtgtca | 2238 | 2257 | SEQ ID NO: 1347 | tgacaggcattttgaaaaa | 9722 | 9741 | 2 | 4 |
| SEQ ID NO: 345 | ttttcccagacagtgtcaa | 2239 | 2258 | SEQ ID NO: 1348 | ttgacaggcattttgaaaa | 9721 | 9740 | 2 | 4 |
| SEQ ID NO: 346 | cattcagaacaagaaaatt | 3395 | 3414 | SEQ ID NO: 1349 | aattccaattttgagaatg | 10406 | 10425 | 2 | 4 |
| SEQ ID NO: 347 | tgaagagaagattgaattt | 3620 | 3639 | SEQ ID NO: 1350 | aaatgtcagctcttgttca | 10894 | 10913 | 2 | 4 |
| SEQ ID NO: 348 | tttgaatggaacacaggca | 3636 | 3655 | SEQ ID NO: 1351 | tgccagtttgaaaaacaaa | 11807 | 11826 | 2 | 4 |
| SEQ ID NO: 349 | ttctagattcgaatatcaa | 4399 | 4418 | SEQ ID NO: 1352 | ttgacatgttgataaagaa | 7369 | 7388 | 2 | 4 |
| SEQ ID NO: 350 | gattcgaatatcaaattca | 4404 | 4423 | SEQ ID NO: 1353 | tgaagtagaccaacaaatc | 7154 | 7173 | 2 | 4 |
| SEQ ID NO: 351 | tgcaacgaccaacttgaag | 5075 | 5094 | SEQ ID NO: 1354 | cttcaggttccatcgtgca | 11376 | 11395 | 2 | 4 |
| SEQ ID NO: 352 | ttaagctctcaaatgacat | 5317 | 5336 | SEQ ID NO: 1355 | atgttgataaagaaattaa | 7374 | 7393 | 2 | 4 |
| SEQ ID NO: 353 | caatttaacaacaatgaat | 6066 | 6085 | SEQ ID NO: 1356 | attcaaactgcctatattg | 13868 | 13887 | 2 | 4 |
| SEQ ID NO: 354 | tgaatacagccaggacttg | 6080 | 6099 | SEQ ID NO: 1357 | caagagcacacggtcttca | 10679 | 10698 | 2 | 4 |
| SEQ ID NO: 355 | catcaatattgatcaattt | 6413 | 6432 | SEQ ID NO: 1358 | aaattccctgaagttgatg | 11478 | 11497 | 2 | 4 |
| SEQ ID NO: 356 | ttgagcatgtcaaacactt | 7051 | 7070 | SEQ ID NO: 1359 | aagtaagtgctaggttcaa | 9373 | 9392 | 2 | 4 |
| SEQ ID NO: 357 | tgaaggagactattcagaa | 7219 | 7238 | SEQ ID NO: 1360 | ttctgcacagaaatattca | 13438 | 13457 | 2 | 4 |
| SEQ ID NO: 358 | ttcaggctcttcagaaagc | 7921 | 7940 | SEQ ID NO: 1361 | gcttgctaacctctctgaa | 12304 | 12323 | 2 | 4 |
| SEQ ID NO: 359 | tccacaaattgaacatccc | 8779 | 8798 | SEQ ID NO: 1362 | gggacctaccaagagtgga | 12525 | 12544 | 2 | 4 |
| SEQ ID NO: 360 | tgaataccaatgctgaact | 10159 | 10178 | SEQ ID NO: 1363 | agttcaatgaatttattca | 13183 | 13202 | 2 | 4 |
| SEQ ID NO: 361 | taaactaatagatgtaatc | 12890 | 12909 | SEQ ID NO: 1364 | gattactatgaaaaattta | 13632 | 13651 | 2 | 4 |
| SEQ ID NO: 362 | ttgacctgtccattcaaaa | 13672 | 13691 | SEQ ID NO: 1365 | ttttaaagaaatcttcaa | 13805 | 13824 | 2 | 4 |
| SEQ ID NO: 363 | gggctgagtgcccttctcg | 11 | 30 | SEQ ID NO: 1366 | cgaggccaggccgcagccc | 76 | 95 | 1 | 4 |
| SEQ ID NO: 364 | ggctgagtgcccttctcgg | 12 | 31 | SEQ ID NO: 1367 | ccgaggccaggccgcagcc | 75 | 94 | 1 | 4 |
| SEQ ID NO: 365 | ctgagtgcccttctcggtt | 14 | 33 | SEQ ID NO: 1368 | aaccgtgcctgaatctcag | 11549 | 11568 | 1 | 4 |
| SEQ ID NO: 366 | tctcggttgctgccgctga | 25 | 44 | SEQ ID NO: 1369 | tcagctgacctcatcgaga | 2160 | 2179 | 1 | 4 |
| SEQ ID NO: 367 | caggccgcagcccaggagc | 82 | 101 | SEQ ID NO: 1370 | gctctgcagcttcatcctg | 368 | 387 | 1 | 4 |
| SEQ ID NO: 368 | gctggcgctgcctgcgctg | 143 | 162 | SEQ ID NO: 1371 | cagcacagaccatttcagc | 4244 | 4263 | 1 | 4 |
| SEQ ID NO: 369 | tgctgctggcgggcgccag | 169 | 188 | SEQ ID NO: 1372 | ctggatgtaaccaccagca | 11178 | 11197 | 1 | 4 |
| SEQ ID NO: 370 | ctggtctgtccaaaagatg | 219 | 238 | SEQ ID NO: 1373 | catcctgaagaccagccag | 380 | 399 | 1 | 4 |
| SEQ ID NO: 371 | ctgagagttccagtggagt | 283 | 302 | SEQ ID NO: 1374 | actcaccctggacattcag | 3383 | 3402 | 1 | 4 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 372 | tccagtggagtccctggga | 291 | 310 | SEQ ID NO: 1375 | tcccggagccaaggctgga | 2675 | 2694 | 1 | 4 |
| SEQ ID NO: 373 | aggttgagctggaggttcc | 346 | 365 | SEQ ID NO: 1376 | ggaaccctctccctcacct | 4728 | 4747 | 1 | 4 |
| SEQ ID NO: 374 | tgagctggaggttccccag | 350 | 369 | SEQ ID NO: 1377 | ctgggaggcatgatgctca | 9163 | 9182 | 1 | 4 |
| SEQ ID NO: 375 | tctgcagcttcatcctgaa | 370 | 389 | SEQ ID NO: 1378 | ttcaaatataatcggcaga | 3261 | 3280 | 1 | 4 |
| SEQ ID NO: 376 | gccagtgcaccctgaaaga | 394 | 413 | SEQ ID NO: 1379 | tcttccgttctgtaatggc | 5794 | 5813 | 1 | 4 |
| SEQ ID NO: 377 | ctctgaggagtttgctgca | 464 | 483 | SEQ ID NO: 1380 | tgcaagaatattttgagag | 6340 | 6359 | 1 | 4 |
| SEQ ID NO: 378 | aggtatgagctcaagctgg | 492 | 511 | SEQ ID NO: 1381 | ccagtttccggggaaacct | 12716 | 12735 | 1 | 4 |
| SEQ ID NO: 379 | tcctttacccggagaaaga | 535 | 554 | SEQ ID NO: 1382 | tcttttgggaagcaagga | 2219 | 2238 | 1 | 4 |
| SEQ ID NO: 380 | catcaagagggcatcatt | 575 | 594 | SEQ ID NO: 1383 | aatggtcaagttcctgatg | 2277 | 2296 | 1 | 4 |
| SEQ ID NO: 381 | tcctggttcccccagagac | 601 | 620 | SEQ ID NO: 1384 | gtctctgaactcagaagga | 13988 | 14007 | 1 | 4 |
| SEQ ID NO: 382 | aagaagccaagcaagtgtt | 622 | 641 | SEQ ID NO: 1385 | aacaaatataatggagtctt | 14072 | 14091 | 1 | 4 |
| SEQ ID NO: 383 | aagcaagtgttgtttctgg | 630 | 649 | SEQ ID NO: 1386 | ccagagccaggtcgagctt | 11042 | 11061 | 1 | 4 |
| SEQ ID NO: 384 | tctggataccgtgtatgga | 644 | 663 | SEQ ID NO: 1387 | tccatgtcccatttacaga | 11356 | 11375 | 1 | 4 |
| SEQ ID NO: 385 | ccactcactttaccgtcaa | 670 | 689 | SEQ ID NO: 1388 | ttgattttaacaaaagtgg | 6817 | 6836 | 1 | 4 |
| SEQ ID NO: 386 | aggaagggcaatgtggcaa | 693 | 712 | SEQ ID NO: 1389 | ttgcaagcaagtctttcct | 3005 | 3024 | 1 | 4 |
| SEQ ID NO: 387 | gcaatgtggcaacagaaat | 700 | 719 | SEQ ID NO: 1390 | atttccatacccgtttgc | 3480 | 3499 | 1 | 4 |
| SEQ ID NO: 388 | caatgtggcaacagaaata | 701 | 720 | SEQ ID NO: 1391 | tattcttcttttccaattg | 13826 | 13845 | 1 | 4 |
| SEQ ID NO: 389 | tggcaacagaaatatccac | 706 | 725 | SEQ ID NO: 1392 | gtggcttcccatattgcca | 1887 | 1906 | 1 | 4 |
| SEQ ID NO: 390 | agagacctgggccagtgtg | 729 | 748 | SEQ ID NO: 1393 | cacattacatttggtctct | 2930 | 2949 | 1 | 4 |
| SEQ ID NO: 391 | tgtgatcgcttcaagccca | 744 | 763 | SEQ ID NO: 1394 | tgggaaagccgccctcaca | 5210 | 5229 | 1 | 4 |
| SEQ ID NO: 392 | gtgatcgcttcaagcccat | 745 | 764 | SEQ ID NO: 1395 | atgggaaagccgccctcac | 5209 | 5228 | 1 | 4 |
| SEQ ID NO: 393 | cagcccacttgctctcatc | 776 | 795 | SEQ ID NO: 1396 | gatgctgaacagtgagctg | 8144 | 8163 | 1 | 4 |
| SEQ ID NO: 394 | gctctcatcaaaggcatga | 786 | 805 | SEQ ID NO: 1397 | tcataacagtactgtgagc | 10337 | 10356 | 1 | 4 |
| SEQ ID NO: 395 | ccttgtcaactctgatcag | 811 | 830 | SEQ ID NO: 1398 | ctgagtgggtttatcaagg | 12445 | 12464 | 1 | 4 |
| SEQ ID NO: 396 | cttgtcaactctgatcagc | 812 | 831 | SEQ ID NO: 1399 | gctgagtgggtttatcaag | 12444 | 12463 | 1 | 4 |
| SEQ ID NO: 397 | agccatctgcaaggagcaa | 884 | 903 | SEQ ID NO: 1400 | ttgcaatgagctcatggct | 3805 | 3824 | 1 | 4 |
| SEQ ID NO: 398 | gccatctgcaaggagcaac | 885 | 904 | SEQ ID NO: 1401 | gttgcaatgagctcatggc | 3804 | 3823 | 1 | 4 |
| SEQ ID NO: 399 | cttcctgcctttctcctac | 908 | 927 | SEQ ID NO: 1402 | gtaggaataaatggagaag | 9453 | 9472 | 1 | 4 |
| SEQ ID NO: 400 | cttttctcctacaagaataa | 916 | 935 | SEQ ID NO: 1403 | ttattgctgaatccaaaag | 13648 | 13667 | 1 | 4 |
| SEQ ID NO: 401 | gatcaacagccgcttcttt | 989 | 1008 | SEQ ID NO: 1404 | aaagccatcactgatgatc | 1661 | 1680 | 1 | 4 |
| SEQ ID NO: 402 | atcaacagccgcttctttg | 990 | 1009 | SEQ ID NO: 1405 | caaagccatcactgatgat | 1660 | 1679 | 1 | 4 |
| SEQ ID NO: 403 | acagccgcttctttggtga | 994 | 1013 | SEQ ID NO: 1406 | tcacaaatcctttggctgt | 9667 | 9686 | 1 | 4 |
| SEQ ID NO: 404 | aagatgggcctcgcatttg | 1023 | 1042 | SEQ ID NO: 1407 | caaaatagaagggaatctt | 2069 | 2088 | 1 | 4 |
| SEQ ID NO: 405 | tgttttgaagactctccag | 1082 | 1101 | SEQ ID NO: 1408 | ctggtaactactttaaaca | 5487 | 5506 | 1 | 4 |
| SEQ ID NO: 406 | ttgaagactctccaggaac | 1086 | 1105 | SEQ ID NO: 1409 | gttcaatgaatttattcaa | 13184 | 13203 | 1 | 4 |
| SEQ ID NO: 407 | aactgaaaaaactaaccat | 1102 | 1121 | SEQ ID NO: 1410 | atggcatttttgcaagtt | 14006 | 14025 | 1 | 4 |
| SEQ ID NO: 408 | ctgaaaaaactaaccatct | 1104 | 1123 | SEQ ID NO: 1411 | agattgatgggcagttcag | 4564 | 4583 | 1 | 4 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 409 | aaaactaaccatctctgag | 1109 | 1128 | SEQ ID NO: 1412 | ctcaaagaatgactttttt | 2570 | 2589 | 1 | 4 |
| SEQ ID NO: 410 | tgagcaaaatatccagaga | 1124 | 1143 | SEQ ID NO: 1413 | tctccagataaaaaactca | 12201 | 12220 | 1 | 4 |
| SEQ ID NO: 411 | caataagctggttactgag | 1154 | 1173 | SEQ ID NO: 1414 | ctcagatcaaagttaattg | 12265 | 12284 | 1 | 4 |
| SEQ ID NO: 412 | tactgagctgagaggcctc | 1166 | 1185 | SEQ ID NO: 1415 | gagggtagtcataacagta | 10329 | 10348 | 1 | 4 |
| SEQ ID NO: 413 | gcctcagtgatgaagcagt | 1180 | 1199 | SEQ ID NO: 1416 | actgttgactcaggaaggc | 12572 | 12591 | 1 | 4 |
| SEQ ID NO: 414 | agtcacatctctcttgcca | 1196 | 1215 | SEQ ID NO: 1417 | tggccacatagcatggact | 8858 | 8877 | 1 | 4 |
| SEQ ID NO: 415 | atctctcttgccacagctg | 1202 | 1221 | SEQ ID NO: 1418 | cagctgacctcatcgagat | 2161 | 2180 | 1 | 4 |
| SEQ ID NO: 416 | tctctcttgccacagctga | 1203 | 1222 | SEQ ID NO: 1419 | tcagctgacctcatcgaga | 2160 | 2179 | 1 | 4 |
| SEQ ID NO: 417 | tgccacagctgattgaggt | 1210 | 1229 | SEQ ID NO: 1420 | acctgcaccaaagctggca | 13955 | 13974 | 1 | 4 |
| SEQ ID NO: 418 | gccacagctgattgaggtg | 1211 | 1230 | SEQ ID NO: 1421 | caccaaaaacccccaatggc | 11240 | 11259 | 1 | 4 |
| SEQ ID NO: 419 | tcactttacaagccttggt | 1240 | 1259 | SEQ ID NO: 1422 | accagatgctgaacagtga | 8140 | 8159 | 1 | 4 |
| SEQ ID NO: 420 | cccttctgatagatgtggt | 1324 | 1343 | SEQ ID NO: 1423 | accacttacagctagaggg | 10816 | 10835 | 1 | 4 |
| SEQ ID NO: 421 | gtcacctacctggtggccc | 1341 | 1360 | SEQ ID NO: 1424 | gggcgacctaagttgtgac | 3431 | 3450 | 1 | 4 |
| SEQ ID NO: 422 | ccttgtatgcgctgagcca | 1432 | 1451 | SEQ ID NO: 1425 | tggctggtaacctaaaagg | 5578 | 5597 | 1 | 4 |
| SEQ ID NO: 423 | gacaaaccctacagggacc | 1472 | 1491 | SEQ ID NO: 1426 | ggtcctttatgattatgtc | 12347 | 12366 | 1 | 4 |
| SEQ ID NO: 424 | tgctaattacctgatggaa | 1508 | 1527 | SEQ ID NO: 1427 | ttcccaaaagcagtcagca | 9930 | 9949 | 1 | 4 |
| SEQ ID NO: 425 | tgactgcactggggatgaa | 1538 | 1557 | SEQ ID NO: 1428 | ttcaggtccatgcaagtca | 10909 | 10928 | 1 | 4 |
| SEQ ID NO: 426 | actgcactggggatgaaga | 1540 | 1559 | SEQ ID NO: 1429 | tcttgaacacaaagtcagt | 5999 | 6018 | 1 | 4 |
| SEQ ID NO: 427 | atgaagattacacctattt | 1552 | 1571 | SEQ ID NO: 1430 | aaatgaaagtaaagatcat | 8110 | 8129 | 1 | 4 |
| SEQ ID NO: 428 | accatggagcagttaactc | 1602 | 1621 | SEQ ID NO: 1431 | gagtaaaccaaaacttggt | 9016 | 9035 | 1 | 4 |
| SEQ ID NO: 429 | gcagttaactccagaactc | 1610 | 1629 | SEQ ID NO: 1432 | gagttactgaaaaagctgc | 13719 | 13738 | 1 | 4 |
| SEQ ID NO: 430 | cagaactcaagtcttcaat | 1621 | 1640 | SEQ ID NO: 1433 | attggatatccaagatctg | 1925 | 1944 | 1 | 4 |
| SEQ ID NO: 431 | caggctctgcggaaaatgg | 1695 | 1714 | SEQ ID NO: 1434 | ccatgacctccagctcctg | 2477 | 2496 | 1 | 4 |
| SEQ ID NO: 432 | ccaggaggttcttcttcag | 1730 | 1749 | SEQ ID NO: 1435 | ctgaaatacaatgctctgg | 5511 | 5530 | 1 | 4 |
| SEQ ID NO: 433 | ggttcttcttcagactttc | 1736 | 1755 | SEQ ID NO: 1436 | gaaaaacttggaaacaacc | 4431 | 4450 | 1 | 4 |
| SEQ ID NO: 434 | tttccttgatgatgcttct | 1751 | 1770 | SEQ ID NO: 1437 | agaatccagatacaagaaa | 6885 | 6904 | 1 | 4 |
| SEQ ID NO: 435 | ggagataagcgactggctg | 1773 | 1792 | SEQ ID NO: 1438 | cagcatgcctagtttctcc | 9944 | 9963 | 1 | 4 |
| SEQ ID NO: 436 | gctgcctatcttatgttga | 1788 | 1807 | SEQ ID NO: 1439 | tcaatatcaaaagcccagc | 12037 | 12056 | 1 | 4 |
| SEQ ID NO: 437 | actttgtggcttcccatat | 1882 | 1901 | SEQ ID NO: 1440 | atatctggaaccttgaagt | 10729 | 10748 | 1 | 4 |
| SEQ ID NO: 438 | gccaatatcttgaactcag | 1902 | 1921 | SEQ ID NO: 1441 | ctgaactcagaaggatggc | 13992 | 14011 | 1 | 4 |
| SEQ ID NO: 439 | aatatcttgaactcagaag | 1905 | 1924 | SEQ ID NO: 1442 | cttccattctgaatatatt | 13370 | 13389 | 1 | 4 |
| SEQ ID NO: 440 | ctcagaagaattggatatc | 1916 | 1935 | SEQ ID NO: 1443 | gataaagattactttgag | 7265 | 7284 | 1 | 4 |
| SEQ ID NO: 441 | aagaattggatatccaaga | 1921 | 1940 | SEQ ID NO: 1444 | tcttcaatttattcttctt | 13817 | 13836 | 1 | 4 |
| SEQ ID NO: 442 | agaattggatatccaagat | 1922 | 1941 | SEQ ID NO: 1445 | atcttcaatttattcttct | 13816 | 13835 | 1 | 4 |
| SEQ ID NO: 443 | tggatatccaagatctgaa | 1927 | 1946 | SEQ ID NO: 1446 | ttcacataccagaattcca | 8317 | 8336 | 1 | 4 |
| SEQ ID NO: 444 | atatccaagatctgaaaaa | 1930 | 1949 | SEQ ID NO: 1447 | tttttaaccagtcagatat | 10177 | 10196 | 1 | 4 |
| SEQ ID NO: 445 | tatccaagatctgaaaaag | 1931 | 1950 | SEQ ID NO: 1448 | cttttaaccagtcagata | 10176 | 10195 | 1 | 4 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 446 | caagatctgaaaaagttag | 1935 | 1954 | SEQ ID NO: 1449 | ctaaattcccatggtcttg | 4965 | 4984 | 1 | 4 |
| SEQ ID NO: 447 | aagatctgaaaaagttagt | 1936 | 1955 | SEQ ID NO: 1450 | actaaattcccatggtctt | 4964 | 4983 | 1 | 4 |
| SEQ ID NO: 448 | tgaaaaagttagtgaaaga | 1942 | 1961 | SEQ ID NO: 1451 | tctttctcgggaatattca | 10622 | 10641 | 1 | 4 |
| SEQ ID NO: 449 | tccaactgtcatggacttc | 1982 | 2001 | SEQ ID NO: 1452 | gaagcacatatgaactgga | 13937 | 13956 | 1 | 4 |
| SEQ ID NO: 450 | tcagaaaattctctcggaa | 1999 | 2018 | SEQ ID NO: 1453 | ttcctttaacaattcctga | 9493 | 9512 | 1 | 4 |
| SEQ ID NO: 451 | ttccatcacttgacccagc | 2044 | 2063 | SEQ ID NO: 1454 | gctgacatagggaatggaa | 8433 | 8452 | 1 | 4 |
| SEQ ID NO: 452 | cccagcctcagccaaaata | 2057 | 2076 | SEQ ID NO: 1455 | tattctatccaagattggg | 7812 | 7831 | 1 | 4 |
| SEQ ID NO: 453 | agcctcagccaaaatagaa | 2060 | 2079 | SEQ ID NO: 1456 | ttctatccaagattgggct | 7814 | 7833 | 1 | 4 |
| SEQ ID NO: 454 | atcttatatttgatccaaa | 2083 | 2102 | SEQ ID NO: 1457 | tttgaaaaacaaagcagat | 11813 | 11832 | 1 | 4 |
| SEQ ID NO: 455 | tcttatatttgatccaaat | 2084 | 2103 | SEQ ID NO: 1458 | attttttgcaagttaaaga | 14011 | 14030 | 1 | 4 |
| SEQ ID NO: 456 | cttcctaaagaaagcatgc | 2109 | 2128 | SEQ ID NO: 1459 | gcatggcattatgatgaag | 3606 | 3625 | 1 | 4 |
| SEQ ID NO: 457 | ctaaagaaagcatgctgaa | 2113 | 2132 | SEQ ID NO: 1460 | ttcagggtgtggagtttag | 5686 | 5705 | 1 | 4 |
| SEQ ID NO: 458 | taaagaaagcatgctgaaa | 2114 | 2133 | SEQ ID NO: 1461 | tttcttaaacattccttta | 9482 | 9501 | 1 | 4 |
| SEQ ID NO: 459 | gagattggcttggaaggaa | 2175 | 2194 | SEQ ID NO: 1462 | ttccctccattaagttctc | 11701 | 11720 | 1 | 4 |
| SEQ ID NO: 460 | ctttgagccaacattggaa | 2198 | 2217 | SEQ ID NO: 1463 | ttccaatgaccaagaaaag | 11060 | 11079 | 1 | 4 |
| SEQ ID NO: 461 | cagacagtgtcaacaaagc | 2245 | 2264 | SEQ ID NO: 1464 | gcttactggacgaactctg | 6134 | 6153 | 1 | 4 |
| SEQ ID NO: 462 | cagtgtcaacaaagctttg | 2249 | 2268 | SEQ ID NO: 1465 | caaattcctggatacactg | 9849 | 9868 | 1 | 4 |
| SEQ ID NO: 463 | agtgtcaacaaagctttgt | 2250 | 2269 | SEQ ID NO: 1466 | acaagaatacgtctacact | 4351 | 4370 | 1 | 4 |
| SEQ ID NO: 464 | ctgatggtgtctctaaggt | 2290 | 2309 | SEQ ID NO: 1467 | acctcggaacaatcctcag | 3325 | 3344 | 1 | 4 |
| SEQ ID NO: 465 | tgatggtgtctctaaggtc | 2291 | 2310 | SEQ ID NO: 1468 | gacctgcgcaacgagatca | 8823 | 8842 | 1 | 4 |
| SEQ ID NO: 466 | aaacatgagcaggatatgg | 2343 | 2362 | SEQ ID NO: 1469 | ccatgatctacatttgttt | 6788 | 6807 | 1 | 4 |
| SEQ ID NO: 467 | gaagctgattaaagatttg | 2387 | 2406 | SEQ ID NO: 1470 | caaaaacattttcaacttc | 5279 | 5298 | 1 | 4 |
| SEQ ID NO: 468 | aaagatttgaaatccaaag | 2397 | 2416 | SEQ ID NO: 1471 | ctttaagttcagcatcttt | 7606 | 7625 | 1 | 4 |
| SEQ ID NO: 469 | gatgggtgcccgcactctg | 2510 | 2529 | SEQ ID NO: 1472 | cagatttgaggattccatc | 7975 | 7994 | 1 | 4 |
| SEQ ID NO: 470 | gggatccccagatgattg | 2532 | 2551 | SEQ ID NO: 1473 | caatcacaagtcgattccc | 9075 | 9094 | 1 | 4 |
| SEQ ID NO: 471 | ttttcttcactacatcttc | 2585 | 2604 | SEQ ID NO: 1474 | gaagtgtcagtggcaaaaa | 10374 | 10393 | 1 | 4 |
| SEQ ID NO: 472 | tcttcactacatcttcatg | 2588 | 2607 | SEQ ID NO: 1475 | catggcattatgatgaaga | 3607 | 3626 | 1 | 4 |
| SEQ ID NO: 473 | tacatcttcatggagaatg | 2595 | 2614 | SEQ ID NO: 1476 | cattatggaggcccatgta | 9437 | 9456 | 1 | 4 |
| SEQ ID NO: 474 | ttcatggagaatgcctttg | 2601 | 2620 | SEQ ID NO: 1477 | caaaatcaactttaatgaa | 6599 | 6618 | 1 | 4 |
| SEQ ID NO: 475 | tcatggagaatgcctttga | 2602 | 2621 | SEQ ID NO: 1478 | tcaacacaatcttcaatga | 13108 | 13127 | 1 | 4 |
| SEQ ID NO: 476 | tttgaactccccactggag | 2616 | 2635 | SEQ ID NO: 1479 | ctccccaggacctttcaaa | 9834 | 9653 | 1 | 4 |
| SEQ ID NO: 477 | ttgaactccccactggagc | 2617 | 2636 | SEQ ID NO: 1480 | gctccccaggacctttcaa | 9833 | 9852 | 1 | 4 |
| SEQ ID NO: 478 | tgaactccccactggagct | 2618 | 2637 | SEQ ID NO: 1481 | agctccccaggacctttca | 9832 | 9851 | 1 | 4 |
| SEQ ID NO: 479 | cactggagctggattacag | 2627 | 2646 | SEQ ID NO: 1482 | ctgtttctgagtcccagtg | 9336 | 9355 | 1 | 4 |
| SEQ ID NO: 480 | actggagctggattacagt | 2628 | 2647 | SEQ ID NO: 1483 | actgtttctgagtcccagt | 9335 | 9354 | 1 | 4 |
| SEQ ID NO: 481 | agttgcaaatatcttcatc | 2644 | 2663 | SEQ ID NO: 1484 | gatgatgccaaaatcaact | 6591 | 6610 | 1 | 4 |
| SEQ ID NO: 482 | gttgcaaatatcttcatct | 2645 | 2664 | SEQ ID NO: 1485 | agatgatgccaaaatcaac | 6590 | 6609 | 1 | 4 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 483 | aaatatcttcatctggagt | 2650 | 2669 | SEQ ID NO: 1486 | actcagaaggatggcattt | 13996 | 14015 | 1 | 4 |
| SEQ ID NO: 484 | taaaactggaagtagccaa | 2695 | 2714 | SEQ ID NO: 1487 | ttggttacaggaggcttta | 7592 | 7611 | 1 | 4 |
| SEQ ID NO: 485 | ggctgaactggtggcaaaa | 2720 | 2739 | SEQ ID NO: 1488 | ttttcttttcagcccagcc | 9220 | 9239 | 1 | 4 |
| SEQ ID NO: 486 | tgtggagtttgtgacaaat | 2750 | 2769 | SEQ ID NO: 1489 | attttcaagcaaatgcaca | 8530 | 8549 | 1 | 4 |
| SEQ ID NO: 487 | ttgtgacaaatatgggcat | 2758 | 2777 | SEQ ID NO: 1490 | atgcgtctaccttacacaa | 9513 | 9532 | 1 | 4 |
| SEQ ID NO: 488 | atgaacaccaacttcttcc | 2811 | 2830 | SEQ ID NO: 1491 | ggaagctgaagtttatcat | 2869 | 2888 | 1 | 4 |
| SEQ ID NO: 489 | cttccacgagtcgggtctg | 2825 | 2844 | SEQ ID NO: 1492 | cagagctatcactgggaag | 5227 | 5246 | 1 | 4 |
| SEQ ID NO: 490 | gagtcgggtctggaggctc | 2832 | 2851 | SEQ ID NO: 1493 | gagcttactggacgaactc | 6132 | 6151 | 1 | 4 |
| SEQ ID NO: 491 | cctaaaagctgggaagctg | 2858 | 2877 | SEQ ID NO: 1494 | cagcctccccagccgtagg | 12112 | 12131 | 1 | 4 |
| SEQ ID NO: 492 | agctgggaagctgaagttt | 2864 | 2883 | SEQ ID NO: 1495 | aaactgttaatttacagct | 5455 | 5474 | 1 | 4 |
| SEQ ID NO: 493 | ccagattagagctggaact | 3106 | 3125 | SEQ ID NO: 1496 | agtttccggggaaacctgg | 12718 | 12737 | 1 | 4 |
| SEQ ID NO: 494 | ggataccctgaagtttgta | 3200 | 3219 | SEQ ID NO: 1497 | tacagtattctgaaaatcc | 8385 | 8404 | 1 | 4 |
| SEQ ID NO: 495 | ctgaggctaccatgacatt | 3244 | 3263 | SEQ ID NO: 1498 | aatgagctcatggcttcag | 3809 | 3828 | 1 | 4 |
| SEQ ID NO: 496 | tgtccagtgaagtccaaat | 3289 | 3308 | SEQ ID NO: 1499 | attttgagaggaatcgaca | 6349 | 6368 | 1 | 4 |
| SEQ ID NO: 497 | aattccggattttgatgtt | 3305 | 3324 | SEQ ID NO: 1500 | aacacatgaatcacaaatt | 8930 | 8949 | 1 | 4 |
| SEQ ID NO: 498 | ttccggattttgatgttga | 3307 | 3326 | SEQ ID NO: 1501 | tcaaaacgagcttcaggaa | 13199 | 13218 | 1 | 4 |
| SEQ ID NO: 499 | cggaacaatcctcagagtt | 3329 | 3348 | SEQ ID NO: 1502 | aacttgtacaactggtccg | 4203 | 4222 | 1 | 4 |
| SEQ ID NO: 500 | tcctcagagttaatgatga | 3337 | 3356 | SEQ ID NO: 1503 | tcatcaattggttacagga | 7585 | 7604 | 1 | 4 |
| SEQ ID NO: 501 | ctcaccctggacattcaga | 3384 | 3403 | SEQ ID NO: 1504 | tctgcagaacaatgctgag | 12431 | 12450 | 1 | 4 |
| SEQ ID NO: 502 | cattcagaacaagaaaatt | 3395 | 3414 | SEQ ID NO: 1505 | aattgactttgtagaaatg | 8096 | 8115 | 1 | 4 |
| SEQ ID NO: 503 | actgaggtcgccctcatgg | 3414 | 3433 | SEQ ID NO: 1506 | ccatgcaagtcagcccagt | 10916 | 10935 | 1 | 4 |
| SEQ ID NO: 504 | ttatttccatacccgttt | 3478 | 3497 | SEQ ID NO: 1507 | aaactgcctatattgataa | 13872 | 13891 | 1 | 4 |
| SEQ ID NO: 505 | gtttgcaagcagaagccag | 3493 | 3512 | SEQ ID NO: 1508 | ctggacttctcttcaaaac | 5400 | 5419 | 1 | 4 |
| SEQ ID NO: 506 | tttgcaagcagaagccaga | 3494 | 3513 | SEQ ID NO: 1509 | tctgggtgtcgacagcaaa | 5264 | 5283 | 1 | 4 |
| SEQ ID NO: 507 | ttgcaagcagaagccagaa | 3495 | 3514 | SEQ ID NO: 1510 | ttctgggtgtcgacagcaa | 5263 | 5282 | 1 | 4 |
| SEQ ID NO: 508 | ctgcttctccaaatggact | 3546 | 3565 | SEQ ID NO: 1511 | agtcaagattgatgggcag | 4559 | 4578 | 1 | 4 |
| SEQ ID NO: 509 | tgctacagcttatggctcc | 3569 | 3588 | SEQ ID NO: 1512 | ggaggctttaagttcagca | 7601 | 7620 | 1 | 4 |
| SEQ ID NO: 510 | acagcttatggctccacag | 3573 | 3592 | SEQ ID NO: 1513 | ctgtatagcaaattcctgt | 5889 | 5908 | 1 | 4 |
| SEQ ID NO: 511 | tttccaagagggtggcatg | 3592 | 3611 | SEQ ID NO: 1514 | catggacttcttctggaaa | 8869 | 8888 | 1 | 4 |
| SEQ ID NO: 512 | ccaagagggtggcatggca | 3595 | 3614 | SEQ ID NO: 1515 | tgcccagcaagcaagttgg | 9353 | 9372 | 1 | 4 |
| SEQ ID NO: 513 | gtggcatggcattatgatg | 3603 | 3622 | SEQ ID NO: 1516 | catccttaacaccttccac | 8063 | 8082 | 1 | 4 |
| SEQ ID NO: 514 | tgatgaagagaagattgaa | 3617 | 3636 | SEQ ID NO: 1517 | ttcactgttcctgaaatca | 7863 | 7882 | 1 | 4 |
| SEQ ID NO: 515 | gaagagaagattgaatttg | 3621 | 3640 | SEQ ID NO: 1518 | caaaaacattttcaacttc | 5279 | 5298 | 1 | 4 |
| SEQ ID NO: 516 | gagaagattgaatttgaat | 3624 | 3643 | SEQ ID NO: 1519 | attcataatcccaactctc | 8270 | 8289 | 1 | 4 |
| SEQ ID NO: 517 | tttgaatggaacacaggca | 3636 | 3655 | SEQ ID NO: 1520 | tgcctttgtgtacaccaaa | 11228 | 11247 | 1 | 4 |
| SEQ ID NO: 518 | aggcaccaatgtagatacc | 3650 | 3669 | SEQ ID NO: 1521 | ggtaacctaaaaggagcct | 5583 | 5602 | 1 | 4 |
| SEQ ID NO: 519 | caaaaaaatgacttccaat | 3668 | 3687 | SEQ ID NO: 1522 | attgaagtacctacttttg | 8358 | 8377 | 1 | 4 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 520 | aaaaaaatgacttccaatt | 3669 | 3688 | SEQ ID NO: 1523 | aattgaagtacctacttttt | 8357 | 8376 | 1 | 4 |
| SEQ ID NO: 521 | aaaaaatgacttccaattt | 3670 | 3689 | SEQ ID NO: 1524 | aaatccaatctcctctttt | 8398 | 8417 | 1 | 4 |
| SEQ ID NO: 522 | cagagtccctcaaacagac | 3752 | 3771 | SEQ ID NO: 1525 | gtctgtgggattccatctg | 4082 | 4101 | 1 | 4 |
| SEQ ID NO: 523 | aaattaatagttgcaatga | 3795 | 3814 | SEQ ID NO: 1526 | tcataagttcaatgaattt | 13178 | 13197 | 1 | 4 |
| SEQ ID NO: 524 | ttcaacctccagaacatgg | 3891 | 3910 | SEQ ID NO: 1527 | ccattgaccagatgctgaa | 8134 | 8153 | 1 | 4 |
| SEQ ID NO: 525 | tgggattgccagacttcca | 3907 | 3926 | SEQ ID NO: 1528 | tggaaatgggcctgcccca | 8895 | 8914 | 1 | 4 |
| SEQ ID NO: 526 | cagtttgaaaattgagatt | 3986 | 4005 | SEQ ID NO: 1529 | aatcacaactcctccactg | 9533 | 9552 | 1 | 4 |
| SEQ ID NO: 527 | gaaaattgagattcctttg | 3992 | 4011 | SEQ ID NO: 1530 | caaaactaccacacatttc | 13686 | 13705 | 1 | 4 |
| SEQ ID NO: 528 | tttgccttttggtggcaaa | 4007 | 4026 | SEQ ID NO: 1531 | tttgagaggaatcgacaaa | 6351 | 6370 | 1 | 4 |
| SEQ ID NO: 529 | ctccagagatctaaagatg | 4028 | 4047 | SEQ ID NO: 1532 | catcaattggttacaggag | 7586 | 7605 | 1 | 4 |
| SEQ ID NO: 530 | tctaaagatgttagagact | 4037 | 4056 | SEQ ID NO: 1533 | agtccttcatgtccctaga | 10025 | 10044 | 1 | 4 |
| SEQ ID NO: 531 | ctgtgggattccatctgcc | 4084 | 4103 | SEQ ID NO: 1534 | ggcattttgaaaaaaacag | 9727 | 9746 | 1 | 4 |
| SEQ ID NO: 532 | atctgccatctcgagagtt | 4096 | 4115 | SEQ ID NO: 1535 | aactctcaaaccctaagat | 8548 | 8567 | 1 | 4 |
| SEQ ID NO: 533 | tctcgagagttccaagtcc | 4104 | 4123 | SEQ ID NO: 1536 | ggacattcctctagcgaga | 8207 | 8226 | 1 | 4 |
| SEQ ID NO: 534 | agtccctacttttaccatt | 4118 | 4137 | SEQ ID NO: 1537 | aatgaatacagccaggact | 6078 | 6097 | 1 | 4 |
| SEQ ID NO: 535 | acttttaccattcccaagt | 4125 | 4144 | SEQ ID NO: 1538 | actttgtagaaatgaaagt | 8101 | 8120 | 1 | 4 |
| SEQ ID NO: 536 | cattcccaagttgtatcaa | 4133 | 4152 | SEQ ID NO: 1539 | ttgaaggacttcaggaatg | 12001 | 12020 | 1 | 4 |
| SEQ ID NO: 537 | accacatgaaggctgactc | 4276 | 4295 | SEQ ID NO: 1540 | gagtaaaccaaaacttggt | 9016 | 9035 | 1 | 4 |
| SEQ ID NO: 538 | tttcctacaatgtgcaagg | 4309 | 4328 | SEQ ID NO: 1541 | cctttaacaattcctgaaa | 9495 | 9514 | 1 | 4 |
| SEQ ID NO: 539 | ctggagaaacaacatatga | 4330 | 4349 | SEQ ID NO: 1542 | tcattctgggtctttccag | 11027 | 11046 | 1 | 4 |
| SEQ ID NO: 540 | atcatgtgatgggtctcta | 4370 | 4369 | SEQ ID NO: 1543 | tagaattacagaaaatgat | 6557 | 6576 | 1 | 4 |
| SEQ ID NO: 541 | catgtgatgggtctctacg | 4372 | 4391 | SEQ ID NO: 1544 | cgtaggcaccgtgggcatg | 12125 | 12144 | 1 | 4 |
| SEQ ID NO: 542 | ttctagattcgaatatcaa | 4399 | 4418 | SEQ ID NO: 1545 | ttgatgatgctgtcaagaa | 7300 | 7319 | 1 | 4 |
| SEQ ID NO: 543 | tggggaccacagatgtctg | 4491 | 4510 | SEQ ID NO: 1546 | cagaattccagcttccca | 8326 | 8345 | 1 | 4 |
| SEQ ID NO: 544 | ctaacactggccggctcaa | 4636 | 4655 | SEQ ID NO: 1547 | ttgaggctattgatgttag | 6976 | 6995 | 1 | 4 |
| SEQ ID NO: 545 | taacactggccggctcaat | 4637 | 4656 | SEQ ID NO: 1548 | attgaggctattgatgtta | 6975 | 6994 | 1 | 4 |
| SEQ ID NO: 546 | aacactggccggctcaatg | 4638 | 4657 | SEQ ID NO: 1549 | cattgaggctattgatgtt | 6974 | 6993 | 1 | 4 |
| SEQ ID NO: 547 | ctggccggctcaatggaga | 4642 | 4661 | SEQ ID NO: 1550 | tctccatctgcgctaccag | 12065 | 12084 | 1 | 4 |
| SEQ ID NO: 548 | agataacaggaagatatga | 4705 | 4724 | SEQ ID NO: 1551 | tcatctcctttcttcatct | 10202 | 10221 | 1 | 4 |
| SEQ ID NO: 549 | tccctcacctccacctctg | 4737 | 4756 | SEQ ID NO: 1552 | cagatatatatctcaggga | 8176 | 8195 | 1 | 4 |
| SEQ ID NO: 550 | agctgactttaaaatctga | 4810 | 4829 | SEQ ID NO: 1553 | tcaggctcttcagaaagct | 7922 | 7941 | 1 | 4 |
| SEQ ID NO: 551 | ctgactttaaaatctgaca | 4812 | 4831 | SEQ ID NO: 1554 | tgtcaagataaacaatcag | 8732 | 8751 | 1 | 4 |
| SEQ ID NO: 552 | caagatggatatgaccttc | 4865 | 4884 | SEQ ID NO: 1555 | gaagtagtactgcatcttg | 6835 | 6854 | 1 | 4 |
| SEQ ID NO: 553 | gctgcgttctgaatatcag | 4901 | 4920 | SEQ ID NO: 1556 | ctgagtcccagtgcccagc | 9342 | 9361 | 1 | 4 |
| SEQ ID NO: 554 | cgttctgaatatcaggctg | 4905 | 4924 | SEQ ID NO: 1557 | cagcaagtacctgagaacg | 8603 | 8622 | 1 | 4 |
| SEQ ID NO: 555 | aattcccatggtcttgagt | 4968 | 4987 | SEQ ID NO: 1558 | actcagatcaaagttaatt | 12264 | 12283 | 1 | 4 |
| SEQ ID NO: 556 | tggtcttgagttaaatgct | 4976 | 4995 | SEQ ID NO: 1559 | agcacagtacgaaaaacca | 10801 | 10820 | 1 | 4 |

TABLE 8-continued

Selected palindromic sequences from human ApoB

|  | Source | Start Index | End Index |  | Match | Start Index | End Index | # | B |
|---|---|---|---|---|---|---|---|---|---|
| SEQ ID NO: 557 | cttgagttaaatgctgaca | 4980 | 4999 | SEQ ID NO: 1560 | tgtccctagaaatctcaag | 10034 | 10053 | 1 | 4 |
| SEQ ID NO: 558 | ttgagttaaatgctgacat | 4981 | 5000 | SEQ ID NO: 1561 | atgtccctagaaatctcaa | 10033 | 10052 | 1 | 4 |
| SEQ ID NO: 559 | tgagttaaatgctgacatc | 4982 | 5001 | SEQ ID NO: 1562 | gatggaaccctctccctca | 4725 | 4744 | 1 | 4 |
| SEQ ID NO: 560 | acttgaagtgtagtctcct | 5086 | 5105 | SEQ ID NO: 1563 | aggaaactcagatcaaagt | 12259 | 12278 | 1 | 4 |
| SEQ ID NO: 561 | agtgtagtctcctggtgct | 5092 | 5111 | SEQ ID NO: 1564 | agcagccagtggcaccact | 12506 | 12525 | 1 | 4 |
| SEQ ID NO: 562 | gtgctggagaatgagctga | 5106 | 5125 | SEQ ID NO: 1565 | tcagccaggtttatagcac | 7726 | 7745 | 1 | 4 |
| SEQ ID NO: 563 | ctgggcatctatgaaatt | 5143 | 5162 | SEQ ID NO: 1566 | aatttctgattaccaccag | 13571 | 13590 | 1 | 4 |
| SEQ ID NO: 564 | atggccgcttcagggaaca | 5170 | 5189 | SEQ ID NO: 1567 | tgttttttggaaatgccat | 8641 | 8660 | 1 | 4 |
| SEQ ID NO: 565 | ttcagtctggatgggaaag | 5199 | 5218 | SEQ ID NO: 1568 | ctttgacaggcattttgaa | 9719 | 9738 | 1 | 4 |
| SEQ ID NO: 566 | ccatgattctgggtgtcga | 5257 | 5276 | SEQ ID NO: 1569 | tcgatgcacatacaaatgg | 5830 | 5849 | 1 | 4 |
| SEQ ID NO: 567 | aaaacattttcaacttcaa | 5281 | 5300 | SEQ ID NO: 1570 | ttgatgttagagtgcttt | 6985 | 7004 | 1 | 4 |
| SEQ ID NO: 568 | cttaagctctcaaatgaca | 5316 | 5335 | SEQ ID NO: 1571 | tgtcctacaacaagttaag | 7247 | 7266 | 1 | 4 |
| SEQ ID NO: 569 | ttaagctctcaaatgacat | 5317 | 5336 | SEQ ID NO: 1572 | atgtcctacaacaagttaa | 7246 | 7265 | 1 | 4 |
| SEQ ID NO: 570 | catgatgggctcatatgct | 5333 | 5352 | SEQ ID NO: 1573 | agcatctttggctcacatg | 7616 | 7635 | 1 | 4 |
| SEQ ID NO: 571 | tgggctcatatgctgaaat | 5338 | 5357 | SEQ ID NO: 1574 | atttatcaaaagaagccca | 12934 | 12953 | 1 | 4 |
| SEQ ID NO: 572 | actggacttctcttcaaaa | 5399 | 5418 | SEQ ID NO: 1575 | ttttggcaagctatacagt | 8372 | 8391 | 1 | 4 |
| SEQ ID NO: 573 | acttctcttcaaaacttga | 5404 | 5423 | SEQ ID NO: 1576 | tcaattgggagagacaagt | 6496 | 6515 | 1 | 4 |
| SEQ ID NO: 574 | ctgacaagttttataagca | 5437 | 5456 | SEQ ID NO: 1577 | tgctttgtgagtttatcag | 9685 | 9704 | 1 | 4 |
| SEQ ID NO: 575 | aagttttataagcaaactg | 5442 | 5461 | SEQ ID NO: 1578 | cagtcatgtagaaaaactt | 4421 | 4440 | 1 | 4 |
| SEQ ID NO: 576 | ctgttaatttacagctaca | 5458 | 5477 | SEQ ID NO: 1579 | tgtactggaaaacgtacag | 6380 | 6399 | 1 | 4 |
| SEQ ID NO: 577 | ttacagctacagccctatt | 5466 | 5485 | SEQ ID NO: 1580 | aatattgatcaatttgtaa | 6417 | 6436 | 1 | 4 |
| SEQ ID NO: 578 | tctggtaactactttaaac | 5486 | 5505 | SEQ ID NO: 1581 | gtttgaaaaacaaagcaga | 11812 | 11831 | 1 | 4 |
| SEQ ID NO: 579 | tttaaacagtgacctgaaa | 5498 | 5517 | SEQ ID NO: 1582 | tttcatttgaaagaataaa | 7024 | 7043 | 1 | 4 |
| SEQ ID NO: 580 | ttaaacagtgacctgaaat | 5499 | 5518 | SEQ ID NO: 1583 | atttcaagcaagaacttaa | 10426 | 10445 | 1 | 4 |
| SEQ ID NO: 581 | cagtgacctgaaatacaat | 5504 | 5523 | SEQ ID NO: 1584 | attggcgtggagcttactg | 6123 | 6142 | 1 | 4 |
| SEQ ID NO: 582 | tgtggctggtaacctaaaa | 5576 | 5595 | SEQ ID NO: 1585 | ttttgctggagaagccaca | 10757 | 10776 | 1 | 4 |
| SEQ ID NO: 583 | ttatcagcaagctataaag | 5649 | 5668 | SEQ ID NO: 1586 | ctttgcactatgttcataa | 12756 | 12775 | 1 | 4 |
| SEQ ID NO: 584 | ggttcagggtgtggagttt | 5684 | 5703 | SEQ ID NO: 1587 | aaacacctaagagtaaacc | 9006 | 9025 | 1 | 4 |
| SEQ ID NO: 585 | attcagactcactgcattt | 5767 | 5786 | SEQ ID NO: 1588 | aaatgctgacatagggaat | 8429 | 8448 | 1 | 4 |
| SEQ ID NO: 586 | ttcagactcactgcatttc | 5768 | 5787 | SEQ ID NO: 1589 | gaaatattatgaacttgaa | 13304 | 13323 | 1 | 4 |
| SEQ ID NO: 587 | tacaaatggcaatgggaaa | 5840 | 5859 | SEQ ID NO: 1590 | tttcctaaagctggatgta | 11168 | 11187 | 1 | 4 |
| SEQ ID NO: 588 | gctgtatagcaaattcctg | 5888 | 5907 | SEQ ID NO: 1591 | caggtccatgcaagtcagc | 10911 | 10930 | 1 | 4 |
| SEQ ID NO: 589 | tgagcagacaggcacctgg | 6035 | 6054 | SEQ ID NO: 1592 | ccagcttccccacatctca | 8333 | 8352 | 1 | 4 |
| SEQ ID NO: 590 | ggcacctggaaactcaaga | 6045 | 6064 | SEQ ID NO: 1593 | tcttcgtgtttcaactgcc | 11213 | 11232 | 1 | 4 |
| SEQ ID NO: 591 | tgaatacagccaggacttg | 6080 | 6099 | SEQ ID NO: 1594 | caagtaagtgctaggttca | 9372 | 9391 | 1 | 4 |
| SEQ ID NO: 592 | gaatacagccaggacttgg | 6081 | 6100 | SEQ ID NO: 1595 | ccaacacttacttgaattc | 10660 | 10679 | 1 | 4 |
| SEQ ID NO: 593 | ctggacgaactctggctga | 6139 | 6158 | SEQ ID NO: 1596 | tcagaaagctaccttccag | 7931 | 7950 | 1 | 4 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 594 | ttttactcagtgagcccat | 6193 | 6212 | SEQ ID NO: 1597 | atggacttcttctggaaaa | 8870 | 8889 | 1 | 4 |
| SEQ ID NO: 595 | gatgagagatgccgttgag | 6233 | 6252 | SEQ ID NO: 1598 | ctcatctcctttcttcatc | 10201 | 10220 | 1 | 4 |
| SEQ ID NO: 596 | aattgttgcttttgtaaag | 6269 | 6288 | SEQ ID NO: 1599 | cttttctaaacttgaaatt | 9056 | 9075 | 1 | 4 |
| SEQ ID NO: 597 | cttttgtaaagtatgataa | 6277 | 6296 | SEQ ID NO: 1600 | ttatgaacttgaagaaaag | 13310 | 13329 | 1 | 4 |
| SEQ ID NO: 598 | tttgtaaagtatgataaaa | 6279 | 6298 | SEQ ID NO: 1601 | ttttcacattagatgcaaa | 8413 | 8432 | 1 | 4 |
| SEQ ID NO: 599 | tccattaacctcccatttt | 6312 | 6331 | SEQ ID NO: 1602 | aaaattgatgatatctgga | 10719 | 10738 | 1 | 4 |
| SEQ ID NO: 600 | ccattaacctcccattttt | 6313 | 6332 | SEQ ID NO: 1603 | aaagggtcatggaaatgg | 8885 | 8904 | 1 | 4 |
| SEQ ID NO: 601 | cttgcaagaatattttgag | 6338 | 6357 | SEQ ID NO: 1604 | ctcaattttgattttcaag | 8520 | 8539 | 1 | 4 |
| SEQ ID NO: 602 | agaatattttgagaggaat | 6344 | 6363 | SEQ ID NO: 1605 | attccctccattaagttct | 11700 | 11719 | 1 | 4 |
| SEQ ID NO: 603 | attatagttgtactggaaa | 6372 | 6391 | SEQ ID NO: 1606 | tttcaagcaagaacttaat | 10427 | 10446 | 1 | 4 |
| SEQ ID NO: 604 | gaagcacatcaatattgat | 6407 | 6426 | SEQ ID NO: 1607 | atcagttcagataaacttc | 7991 | 8010 | 1 | 4 |
| SEQ ID NO: 605 | acatcaatattgatcaatt | 6412 | 6431 | SEQ ID NO: 1608 | aattccctgaagttgatgt | 11479 | 11498 | 1 | 4 |
| SEQ ID NO: 606 | gaaaactcccacagcaagc | 6457 | 6476 | SEQ ID NO: 1609 | gctttctcttccacatttc | 10052 | 10071 | 1 | 4 |
| SEQ ID NO: 607 | ctgaattcattcaattggg | 6486 | 6505 | SEQ ID NO: 1610 | cccatttacagatcttcag | 11363 | 11382 | 1 | 4 |
| SEQ ID NO: 608 | tgaattcattcaattggga | 6487 | 6506 | SEQ ID NO: 1611 | tcccatttacagatcttca | 11362 | 11381 | 1 | 4 |
| SEQ ID NO: 609 | aactgactgctctcacaaa | 6532 | 6551 | SEQ ID NO: 1612 | tttgaggattccatcagtt | 7979 | 7998 | 1 | 4 |
| SEQ ID NO: 610 | aaaagtatagaattacaga | 6550 | 6569 | SEQ ID NO: 1613 | tctggctccctcaacttt | 9042 | 9061 | 1 | 4 |
| SEQ ID NO: 611 | atcaacttaatgaaaaac | 6603 | 6622 | SEQ ID NO: 1614 | gtttattgaaaatattgat | 6803 | 6822 | 1 | 4 |
| SEQ ID NO: 612 | tgatttgaaaatagctatt | 6686 | 6705 | SEQ ID NO: 1615 | aatattattgatgaaatca | 6708 | 6727 | 1 | 4 |
| SEQ ID NO: 613 | atttgaaaatagctattgc | 6688 | 6707 | SEQ ID NO: 1616 | gcaagaacttaatggaaat | 10433 | 10452 | 1 | 4 |
| SEQ ID NO: 614 | attgctaatattattgatg | 6702 | 6721 | SEQ ID NO: 1617 | catcacactgaataccaat | 10151 | 10170 | 1 | 4 |
| SEQ ID NO: 615 | gaaaaattaaaaagtcttg | 6729 | 6748 | SEQ ID NO: 1618 | caagagcttatgggatttc | 11153 | 11172 | 1 | 4 |
| SEQ ID NO: 616 | actatcatatccgtgtaat | 6754 | 6773 | SEQ ID NO: 1619 | attactttgagaaattagt | 7273 | 7292 | 1 | 4 |
| SEQ ID NO: 617 | tattgattttaacaaaagt | 6815 | 6834 | SEQ ID NO: 1620 | acttgacttcagagaaata | 11396 | 11415 | 1 | 4 |
| SEQ ID NO: 618 | ctgcagcagcttaagagac | 6906 | 6925 | SEQ ID NO: 1621 | gtcttcagtgaagctgcag | 10691 | 10710 | 1 | 4 |
| SEQ ID NO: 619 | aaaacaacacattgaggct | 6965 | 6984 | SEQ ID NO: 1622 | agcctcacctcttactttt | 10563 | 10582 | 1 | 4 |
| SEQ ID NO: 620 | ttgagcatgtcaaacactt | 7051 | 7070 | SEQ ID NO: 1623 | aagtagctgagaaaatcaa | 7096 | 7115 | 1 | 4 |
| SEQ ID NO: 621 | tttgaagtagctgagaaaa | 7092 | 7111 | SEQ ID NO: 1624 | ttttcacattagatgcaaa | 8413 | 8432 | 1 | 4 |
| SEQ ID NO: 622 | ttagtagagttggcccacc | 7191 | 7210 | SEQ ID NO: 1625 | ggtggactcttgctgctaa | 7768 | 7787 | 1 | 4 |
| SEQ ID NO: 623 | tgaaggagactattcagaa | 7219 | 7238 | SEQ ID NO: 1626 | ttctcaattttgattttca | 8518 | 8537 | 1 | 4 |
| SEQ ID NO: 624 | gagactattcagaagctaa | 7224 | 7243 | SEQ ID NO: 1627 | ttagccacagctctgtctc | 10293 | 10312 | 1 | 4 |
| SEQ ID NO: 625 | aattagttggatttattga | 7285 | 7304 | SEQ ID NO: 1628 | tcaagaagcttaatgaatt | 7312 | 7331 | 1 | 4 |
| SEQ ID NO: 626 | gcttaatgaattatctttt | 7319 | 7338 | SEQ ID NO: 1629 | aaaacgagcttcaggaagc | 13201 | 13220 | 1 | 4 |
| SEQ ID NO: 627 | ttaacaaattccttgacat | 7357 | 7376 | SEQ ID NO: 1630 | atgtcctacaacaagttaa | 7246 | 7265 | 1 | 4 |
| SEQ ID NO: 628 | aaattaaagtcatttgatt | 7386 | 7405 | SEQ ID NO: 1631 | aatcctttgacaggcattt | 9715 | 9734 | 1 | 4 |
| SEQ ID NO: 629 | gactcaatggtgaaattca | 7456 | 7475 | SEQ ID NO: 1632 | tgaaattcaatcacaagtc | 9068 | 9087 | 1 | 4 |
| SEQ ID NO: 630 | gaaattcaggctctggaac | 7467 | 7486 | SEQ ID NO: 1633 | gttctcaattttgattttc | 8517 | 8536 | 1 | 4 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 631 | actaccacaaaaagctgaa | 7484 | 7503 | SEQ ID NO: 1634 | ttcaggaactattgctagt | 10637 | 10656 | 1 | 4 |
| SEQ ID NO: 632 | ccaaaataaccttaatcat | 7570 | 7589 | SEQ ID NO: 1635 | atgatttccctgaccttgg | 10942 | 10961 | 1 | 4 |
| SEQ ID NO: 633 | aaataaccttaatcatcaa | 7573 | 7592 | SEQ ID NO: 1636 | ttgaagtaaaagaaaattt | 10741 | 10760 | 1 | 4 |
| SEQ ID NO: 634 | tttaagttcagcatctttg | 7607 | 7626 | SEQ ID NO: 1637 | caaatctggatttcttaaa | 9472 | 9491 | 1 | 4 |
| SEQ ID NO: 635 | caggtttatagcacacttg | 7731 | 7750 | SEQ ID NO: 1638 | caagggttcactgttcctg | 7857 | 7876 | 1 | 4 |
| SEQ ID NO: 636 | gttcactgttcctgaaatc | 7862 | 7881 | SEQ ID NO: 1639 | gattctcagatgagggaac | 8914 | 8933 | 1 | 4 |
| SEQ ID NO: 637 | cactgttcctgaaatcaag | 7865 | 7884 | SEQ ID NO: 1640 | cttgaacacaaagtcagtg | 6000 | 6019 | 1 | 4 |
| SEQ ID NO: 638 | actgttcctgaaatcaaga | 7866 | 7885 | SEQ ID NO: 1641 | tcttgaacacaaagtcagt | 5999 | 6018 | 1 | 4 |
| SEQ ID NO: 639 | gcctgcctttgaagtcagt | 7901 | 7920 | SEQ ID NO: 1642 | actgttgactcaggaaggc | 12572 | 12591 | 1 | 4 |
| SEQ ID NO: 640 | taacagatttgaggattcc | 7972 | 7991 | SEQ ID NO: 1643 | ggaagcttctcaagagtta | 13214 | 13233 | 1 | 4 |
| SEQ ID NO: 641 | gttttccacaccagaattt | 8042 | 8061 | SEQ ID NO: 1644 | aaatttctctgctggaaac | 9410 | 9429 | 1 | 4 |
| SEQ ID NO: 642 | tcagaaccattgaccagat | 8128 | 8147 | SEQ ID NO: 1645 | atctgcagaacaatgctga | 12430 | 12449 | 1 | 4 |
| SEQ ID NO: 643 | tagcgagaatcaccctgcc | 8218 | 8237 | SEQ ID NO: 1646 | ggcagcttctggcttgcta | 12293 | 12312 | 1 | 4 |
| SEQ ID NO: 644 | ccttaatgattttcaagtt | 8291 | 8310 | SEQ ID NO: 1647 | aactgttgactcaggaagg | 12571 | 12590 | 1 | 4 |
| SEQ ID NO: 645 | acataccagaattccagct | 8320 | 8339 | SEQ ID NO: 1648 | agctgccagtccttcatgt | 10018 | 10037 | 1 | 4 |
| SEQ ID NO: 646 | aatgctgacatagggaatg | 8430 | 8449 | SEQ ID NO: 1649 | cattaatcctgccatcatt | 9997 | 10016 | 1 | 4 |
| SEQ ID NO: 647 | atgctgacatagggaatgg | 8431 | 8450 | SEQ ID NO: 1650 | ccatttgagatcacggcat | 9237 | 9256 | 1 | 4 |
| SEQ ID NO: 648 | aaccacctcagcaaacgaa | 8450 | 8469 | SEQ ID NO: 1651 | ttcgttttccattaaggtt | 9283 | 9302 | 1 | 4 |
| SEQ ID NO: 649 | agcaggtatcgcagcttcc | 8468 | 8487 | SEQ ID NO: 1652 | ggaagtggccctgaatgct | 10964 | 10983 | 1 | 4 |
| SEQ ID NO: 650 | tgcacaactctcaaaccct | 8543 | 8562 | SEQ ID NO: 1653 | agggaaagagaagattgca | 13493 | 13512 | 1 | 4 |
| SEQ ID NO: 651 | aggagtcagtgaagttctc | 8584 | 8603 | SEQ ID NO: 1654 | gagaacttactatcatcct | 13780 | 13799 | 1 | 4 |
| SEQ ID NO: 652 | tttttggaaatgccattga | 8644 | 8663 | SEQ ID NO: 1655 | tcaatgaatttattcaaaa | 13186 | 13205 | 1 | 4 |
| SEQ ID NO: 653 | aatggagtgattgtcaaga | 8721 | 8740 | SEQ ID NO: 1656 | tcttttcagcccagccatt | 9223 | 9242 | 1 | 4 |
| SEQ ID NO: 654 | gtcaagataaacaatcagc | 8733 | 8752 | SEQ ID NO: 1657 | gctgacttttaaaatctgac | 4811 | 4830 | 1 | 4 |
| SEQ ID NO: 655 | tccacaaattgaacatccc | 8779 | 8798 | SEQ ID NO: 1658 | gggatttcctaaagctgga | 11164 | 11183 | 1 | 4 |
| SEQ ID NO: 656 | ttgaacatccccaaactgg | 8787 | 8806 | SEQ ID NO: 1659 | ccagtttccagggactcaa | 12595 | 12614 | 1 | 4 |
| SEQ ID NO: 657 | acatccccaaactggactt | 8791 | 8810 | SEQ ID NO: 1660 | aagtcgattcccagcatgt | 9082 | 9101 | 1 | 4 |
| SEQ ID NO: 658 | acttctctagtcaggctga | 8806 | 8825 | SEQ ID NO: 1661 | tcagatggaaaaatgaagt | 11002 | 11021 | 1 | 4 |
| SEQ ID NO: 659 | tgaatcacaaattagtttc | 8936 | 8955 | SEQ ID NO: 1662 | gaaagtccataatggttca | 12809 | 12828 | 1 | 4 |
| SEQ ID NO: 660 | agaaggacccctcacttcc | 8960 | 8979 | SEQ ID NO: 1663 | ggaagaagaggcagcttct | 12284 | 12303 | 1 | 4 |
| SEQ ID NO: 661 | ttggactgtccaataagat | 8980 | 8999 | SEQ ID NO: 1664 | atctaaatgcagtagccaa | 11626 | 11645 | 1 | 4 |
| SEQ ID NO: 662 | actgtccaataagatcaat | 8984 | 9003 | SEQ ID NO: 1665 | attgataaaaccatacagt | 13883 | 13902 | 1 | 4 |
| SEQ ID NO: 663 | ctgtccaataagatcaata | 8985 | 9004 | SEQ ID NO: 1666 | tattgataaaaccatacag | 13882 | 13901 | 1 | 4 |
| SEQ ID NO: 664 | gtttatgaatctggctccc | 9033 | 9052 | SEQ ID NO: 1667 | gggaatctgatgaggaaac | 12247 | 12266 | 1 | 4 |
| SEQ ID NO: 665 | atgaatctggctccctcaa | 9037 | 9056 | SEQ ID NO: 1668 | ttgagttgcccaccatcat | 11659 | 11678 | 1 | 4 |
| SEQ ID NO: 666 | ctcaacttttctaaacttg | 9051 | 9070 | SEQ ID NO: 1669 | caagatcgcagactttgag | 11645 | 11664 | 1 | 4 |
| SEQ ID NO: 667 | ctaaaggcatggcactgtt | 9121 | 9140 | SEQ ID NO: 1670 | aacagaaacaatgcattag | 9741 | 9760 | 1 | 4 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 668 | aaggcatggcactgtttgg | 9124 | 9143 | SEQ ID NO: 1671 | ccaagaaaaggcacacctt | 11069 | 11088 | 1 | 4 |
| SEQ ID NO: 669 | atccacaaacaatgaaggg | 9254 | 9273 | SEQ ID NO: 1672 | ccctaacagatttgaggat | 7969 | 7988 | 1 | 4 |
| SEQ ID NO: 670 | ggaatttgaaagttcgttt | 9271 | 9290 | SEQ ID NO: 1673 | aaacaaacacaggcattcc | 9647 | 9666 | 1 | 4 |
| SEQ ID NO: 671 | aataactatgcactgtttc | 9324 | 9343 | SEQ ID NO: 1674 | gaaatactgttttcctatt | 12828 | 12847 | 1 | 4 |
| SEQ ID NO: 672 | gaaacaacgagaacattat | 9424 | 9443 | SEQ ID NO: 1675 | ataaactgcaagatttttc | 13600 | 13619 | 1 | 4 |
| SEQ ID NO: 673 | ttcttgaaaacgacaaagc | 9591 | 9610 | SEQ ID NO: 1676 | gctttccaatgaccaagaa | 11057 | 11076 | 1 | 4 |
| SEQ ID NO: 674 | ataagaaaacaaacacag | 9640 | 9659 | SEQ ID NO: 1677 | ctgtgctttgtgagtttat | 9682 | 9701 | 1 | 4 |
| SEQ ID NO: 675 | aaaacaaacacaggcattc | 9646 | 9665 | SEQ ID NO: 1678 | gaatttgaaagttcgtttt | 9272 | 9291 | 1 | 4 |
| SEQ ID NO: 676 | gcattccatcacaaatcct | 9659 | 9678 | SEQ ID NO: 1679 | aggaagtggccctgaatgc | 10963 | 10982 | 1 | 4 |
| SEQ ID NO: 677 | tttgaaaaaacagaaaca | 9732 | 9751 | SEQ ID NO: 1680 | tgttgaaagatttatcaaa | 12925 | 12944 | 1 | 4 |
| SEQ ID NO: 678 | caatgcattagattttgtc | 9749 | 9768 | SEQ ID NO: 1681 | gacaagaaaaaggggattg | 10271 | 10290 | 1 | 4 |
| SEQ ID NO: 679 | caaagctgaaaaatctcag | 9809 | 9828 | SEQ ID NO: 1682 | ctgagaacttcatcatttg | 11430 | 11449 | 1 | 4 |
| SEQ ID NO: 680 | cctggatacactgttccag | 9855 | 9874 | SEQ ID NO: 1683 | ctggacttctctagtcagg | 8802 | 8821 | 1 | 4 |
| SEQ ID NO: 681 | gttgaagtgtctccattca | 9882 | 9901 | SEQ ID NO: 1684 | tgaatctggctccctcaac | 9038 | 9057 | 1 | 4 |
| SEQ ID NO: 682 | tttctccatcctaggttct | 9956 | 9975 | SEQ ID NO: 1685 | agaatccagatacaagaaa | 6885 | 6904 | 1 | 4 |
| SEQ ID NO: 683 | ttctccatcctaggttctg | 9957 | 9976 | SEQ ID NO: 1686 | cagaatccagatacaagaa | 6884 | 6903 | 1 | 4 |
| SEQ ID NO: 684 | tcattagagctgccagtcc | 10011 | 10030 | SEQ ID NO: 1687 | ggacagtgaaatattatga | 13297 | 13316 | 1 | 4 |
| SEQ ID NO: 685 | tgctgaactttttaaccag | 10169 | 10188 | SEQ ID NO: 1688 | ctggatgtaaccaccagca | 11178 | 11197 | 1 | 4 |
| SEQ ID NO: 686 | ctcctttcttcatcttcat | 10206 | 10225 | SEQ ID NO: 1689 | atgaagcttgctccaggag | 13764 | 13783 | 1 | 4 |
| SEQ ID NO: 687 | tgtcattgatgcactgcag | 10226 | 10245 | SEQ ID NO: 1690 | ctgcgctaccagaaagaca | 12072 | 12091 | 1 | 4 |
| SEQ ID NO: 688 | tgatgcactgcagtacaaa | 10232 | 10251 | SEQ ID NO: 1691 | tttgagttgcccaccatca | 11658 | 11677 | 1 | 4 |
| SEQ ID NO: 689 | agctctgtctctgagcaac | 10301 | 10320 | SEQ ID NO: 1692 | gttgaccacaagcttagct | 10539 | 10558 | 1 | 4 |
| SEQ ID NO: 690 | agccgaaattccaattttg | 10400 | 10419 | SEQ ID NO: 1693 | caaagctggcaccagggct | 13963 | 13982 | 1 | 4 |
| SEQ ID NO: 691 | ttgagaatgaatttcaagc | 10416 | 10435 | SEQ ID NO: 1694 | gcttcaggaagcttctcaa | 13208 | 13227 | 1 | 4 |
| SEQ ID NO: 692 | aaacctactgtctcttcct | 10461 | 10480 | SEQ ID NO: 1695 | aggaaggccaagccagttt | 12583 | 12602 | 1 | 4 |
| SEQ ID NO: 693 | tacttttccattgagtcat | 10575 | 10594 | SEQ ID NO: 1696 | atgattatgtcaacaagta | 12355 | 12374 | 1 | 4 |
| SEQ ID NO: 694 | tcaggtccatgcaagtcag | 10910 | 10929 | SEQ ID NO: 1697 | ctgacatcttaggcactga | 4993 | 5012 | 1 | 4 |
| SEQ ID NO: 695 | atgcaagtcagcccagttc | 10918 | 10937 | SEQ ID NO: 1698 | gaactcagaaggatggcat | 13994 | 14013 | 1 | 4 |
| SEQ ID NO: 696 | tgaatgctaacactaagaa | 10975 | 10994 | SEQ ID NO: 1699 | ttctcaattttgattttca | 8518 | 8537 | 1 | 4 |
| SEQ ID NO: 697 | agaagatcagatggaaaaa | 10996 | 11015 | SEQ ID NO: 1700 | ttttctaaatggaacttct | 12165 | 12184 | 1 | 4 |
| SEQ ID NO: 698 | ggctattcattctccatcc | 11256 | 11275 | SEQ ID NO: 1701 | ggatctaaatgcagtagcc | 11624 | 11643 | 1 | 4 |
| SEQ ID NO: 699 | aaagttttggctgataaat | 11280 | 11299 | SEQ ID NO: 1702 | atttcttaaacattccttt | 9481 | 9500 | 1 | 4 |
| SEQ ID NO: 700 | agtttggctgataaattc | 11282 | 11301 | SEQ ID NO: 1703 | gaatctggctccctcaact | 9039 | 9058 | 1 | 4 |
| SEQ ID NO: 701 | ctgggctgaaactaaatga | 11308 | 11327 | SEQ ID NO: 1704 | tcattctgggtctttccag | 11027 | 11046 | 1 | 4 |
| SEQ ID NO: 702 | cagagaaatacaaatctat | 11405 | 11424 | SEQ ID NO: 1705 | atagcatggacttcttctg | 8865 | 8884 | 1 | 4 |
| SEQ ID NO: 703 | gaggtaaaattccctgaag | 11472 | 11491 | SEQ ID NO: 1706 | cttctggcttgctaacctc | 12298 | 12317 | 1 | 4 |
| SEQ ID NO: 704 | cttttttgagataaccgtg | 11537 | 11556 | SEQ ID NO: 1707 | cacggagttactgaaaaag | 13715 | 13734 | 1 | 4 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 705 | gctggaattgtcattcctt | 11727 | 11746 | SEQ ID NO: 1708 | aaggcatctccacctcagc | 12094 | 12113 | 1 | 4 |
| SEQ ID NO: 706 | gtgtataatgccacttgga | 11787 | 11806 | SEQ ID NO: 1709 | tccaagatgagatcaacac | 13096 | 13115 | 1 | 4 |
| SEQ ID NO: 707 | attccacatgcagctcaac | 11851 | 11870 | SEQ ID NO: 1710 | gttgagaagccccaagaat | 6246 | 6265 | 1 | 4 |
| SEQ ID NO: 708 | tgaagaagatggcaaattt | 11984 | 12003 | SEQ ID NO: 1711 | aaattctcttttcttttca | 9212 | 9231 | 1 | 4 |
| SEQ ID NO: 709 | atcaaaagcccagcgttca | 12042 | 12061 | SEQ ID NO: 1712 | tgaaagtcaagcatctgat | 12661 | 12680 | 1 | 4 |
| SEQ ID NO: 710 | gtgggcatggatatggatg | 12135 | 12154 | SEQ ID NO: 1713 | catccttaacaccttccac | 8063 | 8082 | 1 | 4 |
| SEQ ID NO: 711 | aaatggaacttctactaca | 12171 | 12190 | SEQ ID NO: 1714 | tgtaccataagccatattt | 10080 | 10099 | 1 | 4 |
| SEQ ID NO: 712 | aaaaactcaccatattcaa | 12211 | 12230 | SEQ ID NO: 1715 | ttgatgttagagtgctttt | 6985 | 7004 | 1 | 4 |
| SEQ ID NO: 713 | ctgagaagaaatctgcaga | 12420 | 12439 | SEQ ID NO: 1716 | tctgcacagaaatattcag | 13439 | 13458 | 1 | 4 |
| SEQ ID NO: 714 | acaatgctgagtgggttta | 12439 | 12458 | SEQ ID NO: 1717 | taaatggagtctttattgt | 14078 | 14097 | 1 | 4 |
| SEQ ID NO: 715 | caatgctgagtgggtttat | 12440 | 12459 | SEQ ID NO: 1718 | ataaatggagtctttattg | 14077 | 14096 | 1 | 4 |
| SEQ ID NO: 716 | ttaggcaaattgatgatat | 12469 | 12488 | SEQ ID NO: 1719 | atattgtcagtgcctctaa | 13384 | 13403 | 1 | 4 |
| SEQ ID NO: 717 | ataaactaatagatgtaat | 12889 | 12908 | SEQ ID NO: 1720 | attactatgaaaaatttat | 13633 | 13652 | 1 | 4 |
| SEQ ID NO: 718 | ccaactaatagaagataac | 13031 | 13050 | SEQ ID NO: 1721 | gttattttgctaaacttgg | 14044 | 14063 | 1 | 4 |
| SEQ ID NO: 719 | ttaattatatccaagatga | 13087 | 13106 | SEQ ID NO: 1722 | tcatcctctaattttttaa | 13792 | 13811 | 1 | 4 |
| SEQ ID NO: 720 | tttaaattgttgaaagaaa | 13143 | 13162 | SEQ ID NO: 1723 | tttcatttgaaagaataaa | 7024 | 7043 | 1 | 4 |
| SEQ ID NO: 721 | aagttcaatgaatttattc | 13182 | 13201 | SEQ ID NO: 1724 | gaataccaatgctgaactt | 10160 | 10179 | 1 | 4 |
| SEQ ID NO: 722 | ttgaagaaagatagtcag | 13318 | 13337 | SEQ ID NO: 1725 | ctgagagaagtgtcttcaa | 12399 | 12418 | 1 | 4 |
| SEQ ID NO: 723 | acttccattctgaatatat | 13369 | 13388 | SEQ ID NO: 1726 | atatctggaaccttgaagt | 10729 | 10748 | 1 | 4 |
| SEQ ID NO: 724 | cacagaaatattcaggaat | 13443 | 13462 | SEQ ID NO: 1727 | attccctgaagttgatgtg | 11480 | 11499 | 1 | 4 |
| SEQ ID NO: 725 | ccattgcgacgaagaaaat | 13552 | 13571 | SEQ ID NO: 1728 | attttttattcctgccatgg | 10095 | 10114 | 1 | 4 |
| SEQ ID NO: 726 | tataaactgcaagatttt | 13599 | 13618 | SEQ ID NO: 1729 | aaaattcaaactgcctata | 13865 | 13884 | 1 | 4 |
| SEQ ID NO: 727 | tctgattactatgaaaaat | 13629 | 13648 | SEQ ID NO: 1730 | atttgtaagaaaatacaga | 6428 | 6447 | 1 | 4 |
| SEQ ID NO: 728 | ggagttactgaaaaagctg | 13718 | 13737 | SEQ ID NO: 1731 | cagcatgcctagtttctcc | 9944 | 9963 | 1 | 4 |
| SEQ ID NO: 729 | tgaagcttgctccaggaga | 13765 | 13784 | SEQ ID NO: 1732 | tctcctttcttcatcttca | 10205 | 10224 | 1 | 4 |
| SEQ ID NO: 730 | tgaactggacctgcaccaa | 13947 | 13966 | SEQ ID NO: 1733 | ttggtagagcaagggttca | 7848 | 7867 | 1 | 4 |
| SEQ ID NO: 731 | ttgctaaacttgggggagg | 14050 | 14069 | SEQ ID NO: 1734 | cctcctacagtggtggcaa | 4222 | 4241 | 1 | 4 |
| SEQ ID NO: 732 | gattcgaatatcaaattca | 4404 | 4423 | SEQ ID NO: 1735 | tgaaaacgacaaagcaatc | 9595 | 9614 | 3 | 3 |
| SEQ ID NO: 733 | atttgtttgtcaaagaagt | 4543 | 4562 | SEQ ID NO: 1736 | acttttctaaacttgaaat | 9055 | 9074 | 3 | 3 |
| SEQ ID NO: 734 | tctcggttgctgccgctga | 25 | 44 | SEQ ID NO: 1737 | tcagcccagccatttgaga | 9228 | 9247 | 2 | 3 |
| SEQ ID NO: 735 | gctgaggagcccgcccagc | 39 | 58 | SEQ ID NO: 1738 | gctggatgtaaccaccagc | 11177 | 11196 | 2 | 3 |
| SEQ ID NO: 736 | ctggtctgtccaaagatg | 219 | 238 | SEQ ID NO: 1739 | catcagaaccattgaccag | 8126 | 8145 | 2 | 3 |
| SEQ ID NO: 737 | ctgagagttccagtggagt | 283 | 302 | SEQ ID NO: 1740 | actcaatggtgaaattcag | 7457 | 7476 | 2 | 3 |
| SEQ ID NO: 738 | cagtgcaccctgaaagagg | 396 | 415 | SEQ ID NO: 1741 | cctcacttcctttggactg | 8969 | 8988 | 2 | 3 |
| SEQ ID NO: 739 | ctctgaggagtttgctgca | 464 | 483 | SEQ ID NO: 1742 | tgcaaacttgacttcagag | 11391 | 11410 | 2 | 3 |
| SEQ ID NO: 740 | acatcaagaggggcatcat | 574 | 593 | SEQ ID NO: 1743 | atgacgttcttgagcatgt | 7042 | 7061 | 2 | 3 |
| SEQ ID NO: 741 | ctgatcagcagcagccagt | 822 | 841 | SEQ ID NO: 1744 | actggacttctctagtcag | 8801 | 8820 | 2 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 742 | ggacgctaagaggaagcat | 857 | 876 | SEQ ID NO: 1745 | atgcctacgttccatgtcc | 11346 | 11365 | 2 | 3 |
| SEQ ID NO: 743 | agctgttttgaagactctc | 1079 | 1098 | SEQ ID NO: 1746 | gagaagtgtcttcaaagct | 12403 | 12422 | 2 | 3 |
| SEQ ID NO: 744 | tgaaaaaactaaccatctc | 1105 | 1124 | SEQ ID NO: 1747 | gagatcaacacaatcttca | 13104 | 13123 | 2 | 3 |
| SEQ ID NO: 745 | ctgagctgagaggcctcag | 1168 | 1187 | SEQ ID NO: 1748 | ctgaattactgcacctcag | 3027 | 3046 | 2 | 3 |
| SEQ ID NO: 746 | tgaaacgtgtgcatgccaa | 1303 | 1322 | SEQ ID NO: 1749 | ttggtagagcaagggttca | 7848 | 7867 | 2 | 3 |
| SEQ ID NO: 747 | ccttgtatgcgctgagcca | 1432 | 1451 | SEQ ID NO: 1750 | tggcactgttttggagaagg | 9130 | 9149 | 2 | 3 |
| SEQ ID NO: 748 | aggagctgctggacattgc | 1492 | 1511 | SEQ ID NO: 1751 | gcaagtcagcccagttcct | 10920 | 10939 | 2 | 3 |
| SEQ ID NO: 749 | atttgattctgcgggtcat | 1567 | 1586 | SEQ ID NO: 1752 | atgaaaccaatgacaaaat | 7420 | 7439 | 2 | 3 |
| SEQ ID NO: 750 | tccagaactcaagtcttca | 1619 | 1638 | SEQ ID NO: 1753 | tgaaatacaatgctctgga | 5512 | 5531 | 2 | 3 |
| SEQ ID NO: 751 | ggttcttcttcagactttc | 1736 | 1755 | SEQ ID NO: 1754 | gaaataccaagtcaaaacc | 10447 | 10466 | 2 | 3 |
| SEQ ID NO: 752 | gttgatgaggagtccttca | 1802 | 1821 | SEQ ID NO: 1755 | tgaaaagctgcaatcaac | 13726 | 13745 | 2 | 3 |
| SEQ ID NO: 753 | tccaagatctgaaaaagtt | 1933 | 1952 | SEQ ID NO: 1756 | aactgcttctccaaatgga | 3544 | 3563 | 2 | 3 |
| SEQ ID NO: 754 | agttagtgaaagaagttct | 1948 | 1967 | SEQ ID NO: 1757 | agaattcataatcccaact | 8267 | 8286 | 2 | 3 |
| SEQ ID NO: 755 | gaagggaatcttatatttg | 2076 | 2095 | SEQ ID NO: 1758 | caaaacctactgtctcttc | 10459 | 10478 | 2 | 3 |
| SEQ ID NO: 756 | ggaagctcttttttgggaag | 2213 | 2232 | SEQ ID NO: 1759 | cttcacataccagaattcc | 8316 | 8335 | 2 | 3 |
| SEQ ID NO: 757 | tggaataatgctcagtgtt | 2366 | 2385 | SEQ ID NO: 1760 | aacaaacacaggcattcca | 9648 | 9667 | 2 | 3 |
| SEQ ID NO: 758 | gatttgaaatccaaagaag | 2400 | 2419 | SEQ ID NO: 1761 | cttcatgtccctagaaatc | 10029 | 10048 | 2 | 3 |
| SEQ ID NO: 759 | tccaagaagtcccggaag | 2409 | 2428 | SEQ ID NO: 1762 | cttcagcctgctttctgga | 4943 | 4962 | 2 | 3 |
| SEQ ID NO: 760 | aggaagggctcaaagaatg | 2562 | 2581 | SEQ ID NO: 1763 | cattagagctgccagtcct | 10012 | 10031 | 2 | 3 |
| SEQ ID NO: 761 | agaatgactttttcttca | 2575 | 2594 | SEQ ID NO: 1764 | tgaagatgacgacttttct | 12152 | 12171 | 2 | 3 |
| SEQ ID NO: 762 | tttgtgacaaatatgggca | 2757 | 2776 | SEQ ID NO: 1765 | tgccagttttgaaaaacaaa | 11807 | 11826 | 2 | 3 |
| SEQ ID NO: 763 | ctgaggctaccatgacatt | 3244 | 3263 | SEQ ID NO: 1766 | aatgtcagctcttgttcag | 10895 | 10914 | 2 | 3 |
| SEQ ID NO: 764 | gtagataccaaaaaaatga | 3660 | 3679 | SEQ ID NO: 1767 | tcatttgccctcaacctac | 11442 | 11461 | 2 | 3 |
| SEQ ID NO: 765 | aaatgacttccaatttccc | 3673 | 3692 | SEQ ID NO: 1768 | gggaactgttgaaagattt | 12919 | 12938 | 2 | 3 |
| SEQ ID NO: 766 | atgacttccaatttccctg | 3675 | 3694 | SEQ ID NO: 1769 | caggagaacttactatcat | 13777 | 13796 | 2 | 3 |
| SEQ ID NO: 767 | atctgccatctcgagagtt | 4096 | 4115 | SEQ ID NO: 1770 | aactcctccactgaaagat | 9539 | 9558 | 2 | 3 |
| SEQ ID NO: 768 | atttgtttgtcaaagaagt | 4543 | 4562 | SEQ ID NO: 1771 | acttccgtttaccagaaat | 8239 | 8258 | 2 | 3 |
| SEQ ID NO: 769 | gcagagcttggcctctctg | 5127 | 5146 | SEQ ID NO: 1772 | cagagctttctgccactgc | 13510 | 13529 | 2 | 3 |
| SEQ ID NO: 770 | atatgctgaaatgaaattt | 5345 | 5364 | SEQ ID NO: 1773 | aaattcaaactgcctatat | 13866 | 13885 | 2 | 3 |
| SEQ ID NO: 771 | tcaaaacttgacaacattt | 5412 | 5431 | SEQ ID NO: 1774 | aaatacttccacaaattga | 8772 | 8791 | 2 | 3 |
| SEQ ID NO: 772 | cagtgacctgaaatacaat | 5504 | 5523 | SEQ ID NO: 1775 | attgaacatccccaaactg | 8786 | 8805 | 2 | 3 |
| SEQ ID NO: 773 | tacaaatggcaatgggaaa | 5840 | 5859 | SEQ ID NO: 1776 | tttcaactgcctttgtgta | 11221 | 11240 | 2 | 3 |
| SEQ ID NO: 774 | cttttgtaaagtatgataa | 6277 | 6296 | SEQ ID NO: 1777 | ttattgctgaatccaaaag | 13648 | 13667 | 2 | 3 |
| SEQ ID NO: 775 | ttgtaaagtatgataaaaa | 6280 | 6299 | SEQ ID NO: 1778 | ttttcaagcaaatgcacaa | 8531 | 8550 | 2 | 3 |
| SEQ ID NO: 776 | tccattaacctcccattt | 6312 | 6331 | SEQ ID NO: 1779 | aaagaaaatttgctgga | 10748 | 10767 | 2 | 3 |
| SEQ ID NO: 777 | gattatctgaattcattca | 6480 | 6499 | SEQ ID NO: 1780 | tgaagtagaccaacaaatc | 7154 | 7173 | 2 | 3 |
| SEQ ID NO: 778 | aattgggagagacaagttt | 6498 | 6517 | SEQ ID NO: 1781 | aaactaaatgatctaaatt | 11316 | 11335 | 2 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 779 | atttgaaaatagctattgc | 6688 | 6707 | SEQ ID NO: 1782 | gcaatttctgcacagaaat | 13433 | 13452 | 2 | 3 |
| SEQ ID NO: 780 | tgagcatgtcaaacacttt | 7052 | 7071 | SEQ ID NO: 1783 | aaagccattcagtctctca | 12963 | 12982 | 2 | 3 |
| SEQ ID NO: 781 | ttgaagatgttaacaaatt | 7348 | 7367 | SEQ ID NO: 1784 | aattccatatgaaagtcaa | 12652 | 12671 | 2 | 3 |
| SEQ ID NO: 782 | acttgtcacctacatttct | 7745 | 7764 | SEQ ID NO: 1785 | agaatattttgatccaagt | 13268 | 13287 | 2 | 3 |
| SEQ ID NO: 783 | gttttccacaccagaattt | 8042 | 8061 | SEQ ID NO: 1786 | aaatctggatttcttaaac | 9473 | 9492 | 2 | 3 |
| SEQ ID NO: 784 | ataagtacaaccaaaattt | 9397 | 9416 | SEQ ID NO: 1787 | aaataaatggagtctttat | 14075 | 14094 | 2 | 3 |
| SEQ ID NO: 785 | cgggacctgcggggctgag | 0 | 19 | SEQ ID NO: 1788 | ctcagttaactgtgtcccg | 11563 | 11582 | 1 | 3 |
| SEQ ID NO: 786 | agtgcccttctcggttgct | 17 | 36 | SEQ ID NO: 1789 | agcatctgattgactcact | 12670 | 12689 | 1 | 3 |
| SEQ ID NO: 787 | gctgaggagcccgcccagc | 39 | 58 | SEQ ID NO: 1790 | gctgattgaggtgtccagc | 1217 | 1236 | 1 | 3 |
| SEQ ID NO: 788 | gaggagcccgcccagccag | 42 | 61 | SEQ ID NO: 1791 | ctggatcacagagtccctc | 3744 | 3763 | 1 | 3 |
| SEQ ID NO: 789 | gggccgcgaggccgaggcc | 64 | 83 | SEQ ID NO: 1792 | ggccctgatccccgagccc | 1355 | 1374 | 1 | 3 |
| SEQ ID NO: 790 | ccaggccgcagcccaggag | 81 | 100 | SEQ ID NO: 1793 | ctcccggagccaaggctgg | 2674 | 2693 | 1 | 3 |
| SEQ ID NO: 791 | ggagccgccccaccgcagc | 96 | 115 | SEQ ID NO: 1794 | gctgttttgaagactctcc | 1080 | 1099 | 1 | 3 |
| SEQ ID NO: 792 | gaagaggaaatgctggaaa | 192 | 211 | SEQ ID NO: 1795 | tttcaagttcctgaccttc | 8301 | 8320 | 1 | 3 |
| SEQ ID NO: 793 | caaaagatgcgaccgatt | 229 | 248 | SEQ ID NO: 1796 | aatcttattggggattttg | 7077 | 7096 | 1 | 3 |
| SEQ ID NO: 794 | attcaagcacctccggaag | 245 | 264 | SEQ ID NO: 1797 | cttccacatttcaaggaat | 10059 | 10078 | 1 | 3 |
| SEQ ID NO: 795 | gttccagtggagtccctgg | 289 | 308 | SEQ ID NO: 1798 | ccagcaagtacctgagaac | 8602 | 8621 | 1 | 3 |
| SEQ ID NO: 796 | gactgctgattcaagaagt | 308 | 327 | SEQ ID NO: 1799 | acttgaagaaaagatagtc | 13316 | 13335 | 1 | 3 |
| SEQ ID NO: 797 | gtgccaccaggatcaactg | 325 | 344 | SEQ ID NO: 1800 | cagtgaagctgcagggcac | 10696 | 10715 | 1 | 3 |
| SEQ ID NO: 798 | gatcaactgcaaggttgag | 335 | 354 | SEQ ID NO: 1801 | ctcacctccacctctgatc | 4740 | 4759 | 1 | 3 |
| SEQ ID NO: 799 | actgcaaggttgagctgga | 340 | 359 | SEQ ID NO: 1802 | tccactcacatcctccagt | 1281 | 1300 | 1 | 3 |
| SEQ ID NO: 800 | ccagctctgcagcttcatc | 365 | 384 | SEQ ID NO: 1803 | gatgtggtcacctacctgg | 1335 | 1354 | 1 | 3 |
| SEQ ID NO: 801 | agcttcatcctgaagacca | 375 | 394 | SEQ ID NO: 1804 | tggtgctggagaatgagct | 5104 | 5123 | 1 | 3 |
| SEQ ID NO: 802 | cttcatcctgaagaccagc | 377 | 396 | SEQ ID NO: 1805 | gctggagtaaaactggaag | 2688 | 2707 | 1 | 3 |
| SEQ ID NO: 803 | ccagccagtgcaccctgaa | 391 | 410 | SEQ ID NO: 1806 | ttcaagatgactgcactgg | 1531 | 1550 | 1 | 3 |
| SEQ ID NO: 804 | cagtgcaccctgaaagagg | 396 | 415 | SEQ ID NO: 1807 | cctcacagagctatcactg | 5222 | 5241 | 1 | 3 |
| SEQ ID NO: 805 | tggcttcaaccctgagggc | 419 | 438 | SEQ ID NO: 1808 | gcccactggtcgcctgcca | 3525 | 3544 | 1 | 3 |
| SEQ ID NO: 806 | cttcaaccctgagggcaaa | 422 | 441 | SEQ ID NO: 1809 | tttgagccaacattggaag | 2199 | 2218 | 1 | 3 |
| SEQ ID NO: 807 | ttcaaccctgagggcaaag | 423 | 442 | SEQ ID NO: 1810 | ctttgacaggcattttgaa | 9719 | 9738 | 1 | 3 |
| SEQ ID NO: 808 | cttgctgaagaaaaccaag | 443 | 462 | SEQ ID NO: 1811 | cttgaaattcaatcacaag | 9066 | 9085 | 1 | 3 |
| SEQ ID NO: 809 | tgctgaagaaaaccaagaa | 445 | 464 | SEQ ID NO: 1812 | ttctgctgccttatcagca | 5639 | 5658 | 1 | 3 |
| SEQ ID NO: 810 | ttgctgcagccatgtccag | 475 | 494 | SEQ ID NO: 1813 | ctggtcagtttgcaagcaa | 2996 | 3015 | 1 | 3 |
| SEQ ID NO: 811 | tgctgcagccatgtccagg | 476 | 495 | SEQ ID NO: 1814 | cctggtcagtttgcaagca | 2995 | 3014 | 1 | 3 |
| SEQ ID NO: 812 | agccatgtccaggtatgag | 482 | 501 | SEQ ID NO: 1815 | ctcacatcctccagtggct | 1285 | 1304 | 1 | 3 |
| SEQ ID NO: 813 | agctcaagctggccattcc | 499 | 518 | SEQ ID NO: 1816 | ggaactaccacaaaaagct | 7481 | 7500 | 1 | 3 |
| SEQ ID NO: 814 | agaagggaagcaggttttc | 518 | 537 | SEQ ID NO: 1817 | gaaatcttcaatttattct | 13813 | 13832 | 1 | 3 |
| SEQ ID NO: 815 | aagggaagcaggttttcct | 520 | 539 | SEQ ID NO: 1818 | aggacaccaaaataacctt | 7564 | 7583 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 816 | agaaagatgaacctactta | 547 | 566 | SEQ ID NO: 1619 | taagaactttgccacttct | 4844 | 4863 | 1 | 3 |
| SEQ ID NO: 817 | atcctgaacatcaagaggg | 567 | 586 | SEQ ID NO: 1820 | ccctaacagatttgaggat | 7969 | 7988 | 1 | 3 |
| SEQ ID NO: 818 | tcctgaacatcaagagggg | 568 | 587 | SEQ ID NO: 1821 | cccctaacagatttgagga | 7968 | 7987 | 1 | 3 |
| SEQ ID NO: 819 | ctgaacatcaagaggggca | 570 | 589 | SEQ ID NO: 1822 | tgcctgcctttgaagtcag | 7900 | 7919 | 1 | 3 |
| SEQ ID NO: 820 | aacatcaagaggggcatca | 573 | 592 | SEQ ID NO: 1823 | tgataaaaccaagatgtt | 6290 | 6309 | 1 | 3 |
| SEQ ID NO: 821 | acatcaagaggggcatcat | 574 | 593 | SEQ ID NO: 1824 | atgataaaaccaagatgt | 6289 | 6308 | 1 | 3 |
| SEQ ID NO: 822 | tcatttctgccctcctggt | 589 | 608 | SEQ ID NO: 1825 | accaccagtttgtagatga | 7405 | 7424 | 1 | 3 |
| SEQ ID NO: 823 | ttccccagagacagaaga | 607 | 626 | SEQ ID NO: 1826 | tcttccacatttcaaggaa | 10058 | 10077 | 1 | 3 |
| SEQ ID NO: 824 | gaagaagccaagcaagtgt | 621 | 640 | SEQ ID NO: 1827 | acaccttccacattcctc | 8071 | 8090 | 1 | 3 |
| SEQ ID NO: 825 | ttgtttctggataccgtgt | 639 | 658 | SEQ ID NO: 1828 | acactaaatacttccacaa | 8767 | 8786 | 1 | 3 |
| SEQ ID NO: 826 | tgtatggaaactgctccac | 655 | 674 | SEQ ID NO: 1829 | gtggaggcaacacattaca | 2920 | 2939 | 1 | 3 |
| SEQ ID NO: 827 | aaactgctccactcacttt | 662 | 681 | SEQ ID NO: 1830 | aaagaaacagcatttgttt | 4532 | 4551 | 1 | 3 |
| SEQ ID NO: 828 | actcactttaccgtcaaga | 672 | 691 | SEQ ID NO: 1831 | tcttacttttccattgagt | 10572 | 10591 | 1 | 3 |
| SEQ ID NO: 829 | ctttaccgtcaagacgagg | 677 | 696 | SEQ ID NO: 1832 | cctccagctcctgggaaag | 2483 | 2502 | 1 | 3 |
| SEQ ID NO: 830 | ttaccgtcaagacgaggaa | 679 | 698 | SEQ ID NO: 1833 | ttcctaaagctggatgtaa | 11169 | 11185 | 1 | 3 |
| SEQ ID NO: 831 | acgaggaagggcaatgtgg | 690 | 709 | SEQ ID NO: 1834 | ccacaagtcatcatctcgt | 5956 | 5975 | 1 | 3 |
| SEQ ID NO: 832 | cgaggaagggcaatgtggc | 691 | 710 | SEQ ID NO: 1835 | gccagaagtgagatcctcg | 3507 | 3526 | 1 | 3 |
| SEQ ID NO: 833 | gaggaagggcaatgtggca | 692 | 711 | SEQ ID NO: 1836 | tgccagtctccatgacctc | 2468 | 2487 | 1 | 3 |
| SEQ ID NO: 834 | ggaagggcaatgtggcaac | 694 | 713 | SEQ ID NO: 1837 | gttgctcttaaggacttcc | 13356 | 13375 | 1 | 3 |
| SEQ ID NO: 835 | gaagggcaatgtggcaaca | 695 | 714 | SEQ ID NO: 1838 | tgttgatgaggagtccttc | 1801 | 1820 | 1 | 3 |
| SEQ ID NO: 836 | caggcatcagcccacttgc | 769 | 788 | SEQ ID NO: 1839 | gcaagtctttcctggcctg | 3011 | 3030 | 1 | 3 |
| SEQ ID NO: 837 | aggcatcagcccacttgct | 770 | 789 | SEQ ID NO: 1840 | agcaagtctttcctggcct | 3010 | 3029 | 1 | 3 |
| SEQ ID NO: 838 | tcagcccacttgctctcat | 775 | 794 | SEQ ID NO: 1841 | atgaaagtcaagcatctga | 12660 | 12679 | 1 | 3 |
| SEQ ID NO: 839 | gtcaactctgatcagcagc | 815 | 834 | SEQ ID NO: 1842 | gctgactttaaaatctgac | 4811 | 4830 | 1 | 3 |
| SEQ ID NO: 840 | ggacgctaagaggaagcat | 857 | 876 | SEQ ID NO: 1843 | atgcactgtttctgagtcc | 9331 | 9350 | 1 | 3 |
| SEQ ID NO: 841 | aaggagcaacacctcttcc | 894 | 913 | SEQ ID NO: 1844 | ggaatatcttagcatcctt | 13457 | 13476 | 1 | 3 |
| SEQ ID NO: 842 | aggagcaacacctcttcct | 895 | 914 | SEQ ID NO: 1845 | aggaatatcttagcatcct | 13456 | 13475 | 1 | 3 |
| SEQ ID NO: 843 | caacacctcttcctgcctt | 900 | 919 | SEQ ID NO: 1846 | aaggctgactctgtggttg | 4284 | 4303 | 1 | 3 |
| SEQ ID NO: 844 | aacacctcttcctgccttt | 901 | 920 | SEQ ID NO: 1847 | aaagcaggccgaagctgtt | 1067 | 1086 | 1 | 3 |
| SEQ ID NO: 845 | acaagaataagtatgggat | 925 | 944 | SEQ ID NO: 1848 | atccatgatctacatttgt | 6786 | 6805 | 1 | 3 |
| SEQ ID NO: 846 | caagaataagtatgggatg | 926 | 945 | SEQ ID NO: 1849 | catcactttacaagccttg | 1238 | 1257 | 1 | 3 |
| SEQ ID NO: 847 | tagcacaagtgacacagac | 946 | 965 | SEQ ID NO: 1850 | gtctcttcgttctatgcta | 4584 | 4603 | 1 | 3 |
| SEQ ID NO: 848 | agcacaagtgacacagact | 947 | 966 | SEQ ID NO: 1851 | agtctcttcgttctatgct | 4583 | 4602 | 1 | 3 |
| SEQ ID NO: 849 | gcacaagtgacacagactt | 948 | 967 | SEQ ID NO: 1852 | aagtgtagtctcctggtgc | 5091 | 5110 | 1 | 3 |
| SEQ ID NO: 850 | aacttgaagacacaccaaa | 970 | 989 | SEQ ID NO: 1853 | tttgaggattccatcagtt | 7979 | 7998 | 1 | 3 |
| SEQ ID NO: 851 | gcttctttggtgaaggtac | 1000 | 1019 | SEQ ID NO: 1854 | gtacctactttggcaagc | 8364 | 8383 | 1 | 3 |
| SEQ ID NO: 852 | ctttggtgaaggtactaag | 1004 | 1023 | SEQ ID NO: 1855 | cttatgggatttcctaaag | 11159 | 11178 | 1 | 3 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 853 | tactaagaagatgggcctc | 1016 | 1035 | SEQ ID NO: 1856 | gagggtagtcataacagta | 10329 | 10348 | 1 | 3 |
| SEQ ID NO: 854 | tttgagagcaccaaatcca | 1038 | 1057 | SEQ ID NO: 1857 | tggaagtgtcagtggcaaa | 10372 | 10391 | 1 | 3 |
| SEQ ID NO: 855 | agagcaccaaatccacatc | 1042 | 1061 | SEQ ID NO: 1858 | gatggatatgaccttctct | 4868 | 4887 | 1 | 3 |
| SEQ ID NO: 856 | agctgttttgaagactctc | 1079 | 1098 | SEQ ID NO: 1859 | gagaacatactgggcagct | 5872 | 5891 | 1 | 3 |
| SEQ ID NO: 857 | tgaaaaaactaaccatctc | 1105 | 1124 | SEQ ID NO: 1860 | gagaaaatcaatgccttca | 7104 | 7123 | 1 | 3 |
| SEQ ID NO: 858 | gaaaaaactaaccatctct | 1106 | 1125 | SEQ ID NO: 1861 | agagccaggtcgagctttc | 11044 | 11063 | 1 | 3 |
| SEQ ID NO: 859 | tctgagcaaaatatccaga | 1122 | 1141 | SEQ ID NO: 1862 | tctgatgaggaaactcaga | 12252 | 12271 | 1 | 3 |
| SEQ ID NO: 860 | tctcttcaataagctggtt | 1148 | 1167 | SEQ ID NO: 1863 | aacctcccattttttgaga | 6318 | 6337 | 1 | 3 |
| SEQ ID NO: 861 | ctgagctgagaggcctcag | 1168 | 1187 | SEQ ID NO: 1864 | ctgatccccgagccctcag | 1359 | 1378 | 1 | 3 |
| SEQ ID NO: 862 | tgaagcagtcacatctctc | 1190 | 1209 | SEQ ID NO: 1865 | gagaaaatcaatgccttca | 7104 | 7123 | 1 | 3 |
| SEQ ID NO: 863 | aagcagtcacatctctctt | 1192 | 1211 | SEQ ID NO: 1866 | aagaggcagcttctggctt | 12289 | 12308 | 1 | 3 |
| SEQ ID NO: 864 | ctctcttgccacagctgat | 1204 | 1223 | SEQ ID NO: 1867 | atcaaaagaagcccaagag | 12938 | 12957 | 1 | 3 |
| SEQ ID NO: 865 | tcttgccacagctgattga | 1207 | 1226 | SEQ ID NO: 1868 | tcaaagttaattgggaaga | 12271 | 12290 | 1 | 3 |
| SEQ ID NO: 866 | cttgccacagctgattgag | 1208 | 1227 | SEQ ID NO: 1869 | ctcaattttgattttcaag | 8520 | 8539 | 1 | 3 |
| SEQ ID NO: 867 | tgaggtgtccagccccatc | 1223 | 1242 | SEQ ID NO: 1870 | gatggaaccctctccctca | 4725 | 4744 | 1 | 3 |
| SEQ ID NO: 868 | tcagtgtggacagcctcag | 1259 | 1278 | SEQ ID NO: 1871 | ctgacatcttaggcactga | 4993 | 5012 | 1 | 3 |
| SEQ ID NO: 869 | acatcctccagtggctgaa | 1288 | 1307 | SEQ ID NO: 1872 | ttcagaagctaagcaatgt | 7231 | 7250 | 1 | 3 |
| SEQ ID NO: 870 | gcacagcagctgcgagaga | 1377 | 1396 | SEQ ID NO: 1873 | tctctgaaagacaacgtgc | 12315 | 12334 | 1 | 3 |
| SEQ ID NO: 871 | cagcagctgcgagagatct | 1380 | 1399 | SEQ ID NO: 1874 | agataacattaaacagctg | 13043 | 13062 | 1 | 3 |
| SEQ ID NO: 872 | gcgagggatcagcgcagcc | 1407 | 1426 | SEQ ID NO: 1875 | ggctcaacacagacatcgc | 5710 | 5729 | 1 | 3 |
| SEQ ID NO: 873 | aagacaaaccctacaggga | 1470 | 1489 | SEQ ID NO: 1876 | tcccagaaaacctcttctt | 3928 | 3947 | 1 | 3 |
| SEQ ID NO: 874 | caggagctgctggacattg | 1491 | 1510 | SEQ ID NO: 1877 | caatgagagtccaacctg | 4652 | 4671 | 1 | 3 |
| SEQ ID NO: 875 | aggagctgctggacattgc | 1492 | 1511 | SEQ ID NO: 1878 | gcaagggttcactgttcct | 7856 | 7875 | 1 | 3 |
| SEQ ID NO: 876 | ctgctggacattgctaatt | 1497 | 1516 | SEQ ID NO: 1879 | aattgggaagaagaggcag | 12279 | 12298 | 1 | 3 |
| SEQ ID NO: 877 | gattacacctatttgattc | 1557 | 1576 | SEQ ID NO: 1880 | gaatattttgagaggaatc | 6345 | 6364 | 1 | 3 |
| SEQ ID NO: 878 | atttgattctgcgggtcat | 1567 | 1586 | SEQ ID NO: 1881 | atgaagtagaccaacaaat | 7153 | 7172 | 1 | 3 |
| SEQ ID NO: 879 | tctgcgggtcattggaaat | 1574 | 1593 | SEQ ID NO: 1882 | atttgtaagaaaatacaga | 6428 | 6447 | 1 | 3 |
| SEQ ID NO: 880 | aaccatggagcagttaact | 1601 | 1620 | SEQ ID NO: 1883 | agtttctccatcctaggtt | 9954 | 9973 | 1 | 3 |
| SEQ ID NO: 881 | ggagcagttaactccagaa | 1607 | 1626 | SEQ ID NO: 1884 | ttctgaaaatccaatctcc | 8392 | 8411 | 1 | 3 |
| SEQ ID NO: 882 | actccagaactcaagtctt | 1617 | 1636 | SEQ ID NO: 1885 | aagatcgcagactttgagt | 11646 | 11665 | 1 | 3 |
| SEQ ID NO: 883 | tccagaactcaagtcttca | 1619 | 1638 | SEQ ID NO: 1886 | tgaactcagaagaattgga | 1912 | 1931 | 1 | 3 |
| SEQ ID NO: 884 | aagtacaaagccatcactg | 1655 | 1674 | SEQ ID NO: 1887 | cagtcatgtagaaaaactt | 4421 | 4440 | 1 | 3 |
| SEQ ID NO: 885 | gccatcactgatgatccag | 1664 | 1683 | SEQ ID NO: 1888 | ctggaactctctccatggc | 10875 | 10894 | 1 | 3 |
| SEQ ID NO: 886 | ccatcactgatgatccaga | 1665 | 1684 | SEQ ID NO: 1889 | tctgaactcagaaggatgg | 13991 | 14010 | 1 | 3 |
| SEQ ID NO: 887 | atccagaaagctgccatcc | 1677 | 1696 | SEQ ID NO: 1890 | ggatttcctaaagctggat | 11165 | 11184 | 1 | 3 |
| SEQ ID NO: 888 | cagaaagctgccatccagg | 1680 | 1699 | SEQ ID NO: 1891 | cctgaaatacaatgctctg | 5510 | 5529 | 1 | 3 |
| SEQ ID NO: 889 | acaaggaccaggaggttct | 1723 | 1742 | SEQ ID NO: 1892 | agaaacagcatttgtttgt | 4534 | 4553 | 1 | 3 |

TABLE 8-continued

Selected palindromic sequences from human ApoB

| | Source | Start Index | End Index | Match | Start Index | End Index | # | B |
|---|---|---|---|---|---|---|---|---|
| SEQ ID NO: 890 | aggaccaggaggttcttct | 1726 | 1745 | SEQ ID NO: 1893 agaagctaagcaatgtcct | 7234 | 7253 | 1 | 3 |
| SEQ ID NO: 891 | accaggaggttcttcttca | 1729 | 1748 | SEQ ID NO: 1894 tgaaggctgactctgtggt | 4282 | 4301 | 1 | 3 |
| SEQ ID NO: 892 | tcttcagactttccttgat | 1742 | 1761 | SEQ ID NO: 1895 atcaggaagggctcaaaga | 2559 | 2578 | 1 | 3 |
| SEQ ID NO: 893 | ttcagactttccttgatga | 1744 | 1763 | SEQ ID NO: 1896 tcattactcctgggctgaa | 11299 | 11318 | 1 | 3 |
| SEQ ID NO: 894 | gttgatgaggagtccttca | 1802 | 1821 | SEQ ID NO: 1897 tgaatctggctccctcaac | 9038 | 9057 | 1 | 3 |
| SEQ ID NO: 895 | cttcacaggcagatattaa | 1816 | 1835 | SEQ ID NO: 1898 ttaatcgagaggtatgaag | 7140 | 7159 | 1 | 3 |
| SEQ ID NO: 896 | ttcacaggcagatattaac | 1817 | 1836 | SEQ ID NO: 1899 gttaatcgagaggtatgaa | 7139 | 7158 | 1 | 3 |
| SEQ ID NO: 897 | ggcagatattaacaaaatt | 1823 | 1842 | SEQ ID NO: 1900 aattgcattagatgatgcc | 6581 | 6600 | 1 | 3 |
| SEQ ID NO: 898 | atattaacaaaattgtcca | 1828 | 1847 | SEQ ID NO: 1901 tggagtttgtgacaaatat | 2752 | 2771 | 1 | 3 |
| SEQ ID NO: 899 | acaaaattgtccaaattct | 1834 | 1853 | SEQ ID NO: 1902 agaaacagcatttgtttgt | 4534 | 4553 | 1 | 3 |
| SEQ ID NO: 900 | gagcaagtgaagaactttg | 1869 | 1888 | SEQ ID NO: 1903 caaatgacatgatgggctc | 5326 | 5345 | 1 | 3 |
| SEQ ID NO: 901 | gtgaagaactttgtggctt | 1875 | 1894 | SEQ ID NO: 1904 aagcatctgattgactcac | 12669 | 12688 | 1 | 3 |
| SEQ ID NO: 902 | agaactttgtggcttccca | 1879 | 1898 | SEQ ID NO: 1905 tgggcctgccccagattct | 8901 | 8920 | 1 | 3 |
| SEQ ID NO: 903 | tttgtggcttcccatattg | 1884 | 1903 | SEQ ID NO: 1906 caataagatcaatagcaaa | 8990 | 9009 | 1 | 3 |
| SEQ ID NO: 904 | tggcttcccatattgccaa | 1888 | 1907 | SEQ ID NO: 1907 ttggctcacatgaaggcca | 7623 | 7642 | 1 | 3 |
| SEQ ID NO: 905 | ttcccatattgccaatatc | 1892 | 1911 | SEQ ID NO: 1908 gatatacactagggaggaa | 12737 | 12756 | 1 | 3 |
| SEQ ID NO: 906 | tcccatattgccaatatct | 1893 | 1912 | SEQ ID NO: 1909 agatcaaagttaattggga | 12268 | 12287 | 1 | 3 |
| SEQ ID NO: 907 | ttgccaatatcttgaactc | 1900 | 1919 | SEQ ID NO: 1910 gagtcccagtgcccagcaa | 9344 | 9363 | 1 | 3 |
| SEQ ID NO: 908 | ttggatatccaagatctga | 1926 | 1945 | SEQ ID NO: 1911 tcagtataagtacaaccaa | 9392 | 9411 | 1 | 3 |
| SEQ ID NO: 909 | tccaagatctgaaaaagtt | 1933 | 1952 | SEQ ID NO: 1912 aacttccaactgtcatgga | 1978 | 1997 | 1 | 3 |
| SEQ ID NO: 910 | ctgaaaaagttagtgaaag | 1941 | 1960 | SEQ ID NO: 1913 ctttgaagtcagtcttcag | 7907 | 7926 | 1 | 3 |
| SEQ ID NO: 911 | agttagtgaaagaagttct | 1948 | 1967 | SEQ ID NO: 1914 agaatctcaacttccaact | 1970 | 1989 | 1 | 3 |
| SEQ ID NO: 912 | aatctcaacttccaactgt | 1972 | 1991 | SEQ ID NO: 1915 acaggggtcctttatgatt | 12342 | 12361 | 1 | 3 |
| SEQ ID NO: 913 | gtcatggacttcagaaaat | 1989 | 2008 | SEQ ID NO: 1916 atttgaaagaataaatgac | 7028 | 7047 | 1 | 3 |
| SEQ ID NO: 914 | tcaactctacaaatctgtt | 2021 | 2040 | SEQ ID NO: 1917 aacacattgaggctattga | 6970 | 6989 | 1 | 3 |
| SEQ ID NO: 915 | aactctacaaatctgtttc | 2023 | 2042 | SEQ ID NO: 1918 gaaaaaggggattgaagtt | 10276 | 10295 | 1 | 3 |
| SEQ ID NO: 916 | aaatagaagggaatcttat | 2071 | 2090 | SEQ ID NO: 1919 ataagcaaactgttaattt | 5449 | 5468 | 1 | 3 |
| SEQ ID NO: 917 | agaagggaatcttatattt | 2075 | 2094 | SEQ ID NO: 1920 aaatgcactgctgcgttct | 4892 | 4911 | 1 | 3 |
| SEQ ID NO: 918 | gaagggaatcttatatttg | 2076 | 2095 | SEQ ID NO: 1921 caaaaacattttcaacttc | 5279 | 5298 | 1 | 3 |
| SEQ ID NO: 919 | tgatccaaataactacctt | 2093 | 2112 | SEQ ID NO: 1922 aaggaagaaagaaaaatca | 3453 | 3472 | 1 | 3 |
| SEQ ID NO: 920 | tggatttgcttcagctgac | 2150 | 2169 | SEQ ID NO: 1923 gtcagcccagttccttcca | 10924 | 10943 | 1 | 3 |
| SEQ ID NO: 921 | tttgcttcagctgacctca | 2154 | 2173 | SEQ ID NO: 1924 tgaggaaactcagatcaaa | 12257 | 12276 | 1 | 3 |
| SEQ ID NO: 922 | cttggaaggaaaggctttt | 2183 | 2202 | SEQ ID NO: 1925 aaagcattggtagagcaag | 7842 | 7861 | 1 | 3 |
| SEQ ID NO: 923 | tggaaggaaaggctttga | 2185 | 2204 | SEQ ID NO: 1926 tcaagtctgtgggattcca | 4078 | 4097 | 1 | 3 |
| SEQ ID NO: 924 | ggctttgagccaacattgg | 2196 | 2215 | SEQ ID NO: 1927 ccaagaggtatttaaagcc | 12950 | 12969 | 1 | 3 |
| SEQ ID NO: 925 | tgagccaacattggaagct | 2201 | 2220 | SEQ ID NO: 1928 agcttctgccactgctca | 13513 | 13532 | 1 | 3 |
| SEQ ID NO: 926 | gagccaacattggaagctc | 2202 | 2221 | SEQ ID NO: 1929 gagctttctgccactgctc | 13512 | 13531 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 927 | aacattggaagctcttttt | 2207 | 2226 | SEQ ID NO: 1930 | aaaagaaacagcatttgtt | 4531 | 4550 | 1 | 3 |
| SEQ ID NO: 928 | tggaagctcttttggggaa | 2212 | 2231 | SEQ ID NO: 1931 | ttccggcacgtgggttcca | 3777 | 3796 | 1 | 3 |
| SEQ ID NO: 929 | ctcttttgggaagcaagg | 2218 | 2237 | SEQ ID NO: 1932 | ccttactgactttgcagag | 7790 | 7809 | 1 | 3 |
| SEQ ID NO: 930 | ttttgggaagcaaggatt | 2221 | 2240 | SEQ ID NO: 1933 | aatcattgaaaattaaaa | 6722 | 6741 | 1 | 3 |
| SEQ ID NO: 931 | ttttcccagacagtgtcaa | 2239 | 2258 | SEQ ID NO: 1934 | ttgatgaaatcattgaaaa | 6715 | 6734 | 1 | 3 |
| SEQ ID NO: 932 | ttggctataccaaagatga | 2323 | 2342 | SEQ ID NO: 1935 | tcattgctcccggagccaa | 2668 | 2687 | 1 | 3 |
| SEQ ID NO: 933 | ataccaaagatgataaaca | 2329 | 2348 | SEQ ID NO: 1936 | tgttgcttttgtaaagtat | 6272 | 6291 | 1 | 3 |
| SEQ ID NO: 934 | gagcaggatatggtaaatg | 2349 | 2368 | SEQ ID NO: 1937 | catttcagccttcgggctc | 4254 | 4273 | 1 | 3 |
| SEQ ID NO: 935 | atggtaaatggaataatgc | 2358 | 2377 | SEQ ID NO: 1938 | gcatgcctagtttctccat | 9946 | 9965 | 1 | 3 |
| SEQ ID NO: 936 | tggtaaatggaataatgct | 2359 | 2378 | SEQ ID NO: 1939 | agcacagtacgaaaaacca | 10801 | 10820 | 1 | 3 |
| SEQ ID NO: 937 | taaatggaataatgctcag | 2362 | 2381 | SEQ ID NO: 1940 | ctgaaagagatgaaattta | 13059 | 13078 | 1 | 3 |
| SEQ ID NO: 938 | tggaataatgctcagtgtt | 2366 | 2385 | SEQ ID NO: 1941 | aacagatttgaggattcca | 7973 | 7992 | 1 | 3 |
| SEQ ID NO: 939 | tcagtgttgagaagctgat | 2377 | 2396 | SEQ ID NO: 1942 | atcacaactcctccactga | 9534 | 9553 | 1 | 3 |
| SEQ ID NO: 940 | cagtgttgagaagctgatt | 2378 | 2397 | SEQ ID NO: 1943 | aatcacaactcctccactg | 9533 | 9552 | 1 | 3 |
| SEQ ID NO: 941 | agtgttgagaagctgatta | 2379 | 2398 | SEQ ID NO: 1944 | taatcacaactcctccact | 9532 | 9551 | 1 | 3 |
| SEQ ID NO: 942 | gattaaagatttgaaatcc | 2393 | 2412 | SEQ ID NO: 1945 | ggatactaagtaccaaatc | 6866 | 6885 | 1 | 3 |
| SEQ ID NO: 943 | gatttgaaatccaaagaag | 2400 | 2419 | SEQ ID NO: 1946 | cttccgtttaccagaaatc | 8240 | 8259 | 1 | 3 |
| SEQ ID NO: 944 | atttgaaatccaaagaagt | 2401 | 2420 | SEQ ID NO: 1947 | acttccgtttaccagaaat | 8239 | 8258 | 1 | 3 |
| SEQ ID NO: 945 | atccaaagaagtcccggaa | 2408 | 2427 | SEQ ID NO: 1948 | ttccaatttccctgtggat | 3680 | 3699 | 1 | 3 |
| SEQ ID NO: 946 | tccaaagaagtcccggaag | 2409 | 2428 | SEQ ID NO: 1949 | cttccaatttccctgtgga | 3679 | 3698 | 1 | 3 |
| SEQ ID NO: 947 | agagcctacctccgcatct | 2430 | 2449 | SEQ ID NO: 1950 | agattaatccgctggctct | 8563 | 8582 | 1 | 3 |
| SEQ ID NO: 948 | gagcctacctccgcatctt | 2431 | 2450 | SEQ ID NO: 1951 | aagattaatccgctggctc | 8562 | 8581 | 1 | 3 |
| SEQ ID NO: 949 | cttgggagaggagcttggt | 2447 | 2466 | SEQ ID NO: 1952 | accactgggacctaccaag | 12519 | 12538 | 1 | 3 |
| SEQ ID NO: 950 | ggagcttggttttgccagt | 2456 | 2475 | SEQ ID NO: 1953 | actggtggcaaaaccctcc | 2726 | 2745 | 1 | 3 |
| SEQ ID NO: 951 | ttggttttgccagtctcca | 2461 | 2480 | SEQ ID NO: 1954 | tggagaagccacactccaa | 10763 | 10782 | 1 | 3 |
| SEQ ID NO: 952 | cagtctccatgacctccag | 2471 | 2490 | SEQ ID NO: 1955 | ctggtcgcctgccaaactg | 3530 | 3549 | 1 | 3 |
| SEQ ID NO: 953 | ctccatgacctccagctcc | 2475 | 2494 | SEQ ID NO: 1956 | ggagtcattgctcccggag | 2664 | 2683 | 1 | 3 |
| SEQ ID NO: 954 | ctgggaaagctgcttctga | 2493 | 2512 | SEQ ID NO: 1957 | tcagaaagctaccttccag | 7931 | 7950 | 1 | 3 |
| SEQ ID NO: 955 | gaggtcatcaggaagggct | 2553 | 2572 | SEQ ID NO: 1958 | agccagaagtgagatcctc | 3506 | 3525 | 1 | 3 |
| SEQ ID NO: 956 | aagaatgacttttttcttc | 2574 | 2593 | SEQ ID NO: 1959 | gaaggcatctgggagtctt | 3827 | 3846 | 1 | 3 |
| SEQ ID NO: 957 | ctttttcttcactacatc | 2582 | 2601 | SEQ ID NO: 1960 | gatgcttacaacactaaag | 6099 | 6118 | 1 | 3 |
| SEQ ID NO: 958 | catcttcatggagaatgcc | 2597 | 2616 | SEQ ID NO: 1961 | ggcacttccaaaattgatg | 10710 | 10729 | 1 | 3 |
| SEQ ID NO: 959 | cttcatggagaatgccttt | 2600 | 2619 | SEQ ID NO: 1962 | aaagttaattgggaagaag | 12273 | 12292 | 1 | 3 |
| SEQ ID NO: 960 | aatgcctttgaactcccca | 2610 | 2629 | SEQ ID NO: 1963 | tgggctggcttcagccatt | 5729 | 5748 | 1 | 3 |
| SEQ ID NO: 961 | gcctttgaactccccactg | 2613 | 2632 | SEQ ID NO: 1964 | cagtctgaacattgcaggc | 5375 | 5394 | 1 | 3 |
| SEQ ID NO: 962 | caaggctggagtaaaactg | 2684 | 2703 | SEQ ID NO: 1965 | cagtgcaacgaccaacttg | 5072 | 5091 | 1 | 3 |
| SEQ ID NO: 963 | tggagtaaaactggaagta | 2690 | 2709 | SEQ ID NO: 1966 | tactccaacgccagctcca | 3051 | 3070 | 1 | 3 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 964 | ggaagtagccaacatgcag | 2702 | 2721 | SEQ ID NO: 1967 | ctgccatctcgagagttcc | 4098 | 4117 | 1 | 3 |
| SEQ ID NO: 965 | tttgtgacaaatatgggca | 2757 | 2776 | SEQ ID NO: 1968 | tgcctttgtgtacaccaaa | 11228 | 11247 | 1 | 3 |
| SEQ ID NO: 966 | tgtgacaaatatgggcatc | 2759 | 2778 | SEQ ID NO: 1969 | gatgggtctctacgccaca | 4377 | 4396 | 1 | 3 |
| SEQ ID NO: 967 | ggacttcgctaggagtggg | 2786 | 2805 | SEQ ID NO: 1970 | cccaaggccacaggggtcc | 12333 | 12352 | 1 | 3 |
| SEQ ID NO: 968 | gtggggtccagatgaacac | 2800 | 2819 | SEQ ID NO: 1971 | gtgttctagacctctccac | 4171 | 4190 | 1 | 3 |
| SEQ ID NO: 969 | ttccacgagtcgggtctgg | 2826 | 2845 | SEQ ID NO: 1972 | ccagaatctgtaccaggaa | 12554 | 12573 | 1 | 3 |
| SEQ ID NO: 970 | agtcgggtctggaggctca | 2833 | 2852 | SEQ ID NO: 1973 | tgagaactacgagctgact | 4799 | 4818 | 1 | 3 |
| SEQ ID NO: 971 | tcgggtctggaggctcatg | 2835 | 2854 | SEQ ID NO: 1974 | catgaaggccaaattccga | 7631 | 7650 | 1 | 3 |
| SEQ ID NO: 972 | aaaagctgggaagctgaag | 2861 | 2880 | SEQ ID NO: 1975 | cttccagacacctgatttt | 7943 | 7962 | 1 | 3 |
| SEQ ID NO: 973 | aagctgaagtttatcattc | 2871 | 2890 | SEQ ID NO: 1976 | gaatttacaattgttgctt | 6261 | 6280 | 1 | 3 |
| SEQ ID NO: 974 | gagaccagtcaagctgctc | 2900 | 2919 | SEQ ID NO: 1977 | gagcttcaggaagcttctc | 13206 | 13225 | 1 | 3 |
| SEQ ID NO: 975 | gcaacacattacatttggt | 2926 | 2945 | SEQ ID NO: 1978 | accagtcagatattgttgc | 10183 | 10202 | 1 | 3 |
| SEQ ID NO: 976 | acattacatttggtctcta | 2931 | 2950 | SEQ ID NO: 1979 | tagaatatgaactaaatgt | 11881 | 11900 | 1 | 3 |
| SEQ ID NO: 977 | cattacatttggtctctac | 2932 | 2951 | SEQ ID NO: 1980 | gtagctgagaaaatcaatg | 7098 | 7117 | 1 | 3 |
| SEQ ID NO: 978 | aaacggaggtgatcccacc | 2956 | 2975 | SEQ ID NO: 1981 | ggtggatacccctgaagttt | 3197 | 3216 | 1 | 3 |
| SEQ ID NO: 979 | attgagaacaggcagtcct | 2979 | 2998 | SEQ ID NO: 1982 | aggaaaagcgcacctcaat | 12023 | 12042 | 1 | 3 |
| SEQ ID NO: 980 | tgagaacaggcagtcctgg | 2981 | 3000 | SEQ ID NO: 1983 | ccagcttccccacatctca | 8333 | 8352 | 1 | 3 |
| SEQ ID NO: 981 | ctgcacctcaggcgcttac | 3035 | 3054 | SEQ ID NO: 1984 | gtaagaaaatacagagcag | 6432 | 6451 | 1 | 3 |
| SEQ ID NO: 982 | tccacagactccgcctcct | 3066 | 3085 | SEQ ID NO: 1985 | aggacagagccttggtgga | 3184 | 3203 | 1 | 3 |
| SEQ ID NO: 983 | ctgaccggggacaccagat | 3093 | 3112 | SEQ ID NO: 1986 | atctgatgaggaaaactcag | 12251 | 12270 | 1 | 3 |
| SEQ ID NO: 984 | tagagctggaactgaggcc | 3112 | 3131 | SEQ ID NO: 1987 | ggcctctctgggcatcta | 5136 | 5155 | 1 | 3 |
| SEQ ID NO: 985 | ctatgagctccagagagag | 3167 | 3186 | SEQ ID NO: 1988 | ctctcacaaaaaagtatag | 6541 | 6560 | 1 | 3 |
| SEQ ID NO: 986 | cttggtggatacccctgaag | 3194 | 3213 | SEQ ID NO: 1989 | cttcaggaagcttctcaag | 13209 | 13228 | 1 | 3 |
| SEQ ID NO: 987 | ttgtaactcaagcagaagg | 3214 | 3233 | SEQ ID NO: 1990 | ccttacacaataatcacaa | 9522 | 9541 | 1 | 3 |
| SEQ ID NO: 988 | taactcaagcagaaggtgc | 3217 | 3236 | SEQ ID NO: 1991 | gcacctagctggaaagtta | 6947 | 6966 | 1 | 3 |
| SEQ ID NO: 989 | gcagaaggtgcgaagcaga | 3225 | 3244 | SEQ ID NO: 1992 | tctgtgggattccatctgc | 4083 | 4102 | 1 | 3 |
| SEQ ID NO: 990 | cagaaggtgcgaagcagac | 3226 | 3245 | SEQ ID NO: 1993 | gtctgtgggattccatctg | 4082 | 4101 | 1 | 3 |
| SEQ ID NO: 991 | gtatgaccttgtccagtga | 3280 | 3299 | SEQ ID NO: 1994 | tcaccaacggagaacatac | 10843 | 10862 | 1 | 3 |
| SEQ ID NO: 992 | tatgaccttgtccagtgaa | 3281 | 3300 | SEQ ID NO: 1995 | ttcaccaacggagaacata | 10842 | 10861 | 1 | 3 |
| SEQ ID NO: 993 | gaagtccaaattccggatt | 3297 | 3316 | SEQ ID NO: 1996 | aatctcaagctttctcttc | 10044 | 10063 | 1 | 3 |
| SEQ ID NO: 994 | gagggcaaaacgtcttaca | 3363 | 3382 | SEQ ID NO: 1997 | tgtacaactggtccgcctc | 4207 | 4226 | 1 | 3 |
| SEQ ID NO: 995 | agggcaaaacgtcttacag | 3364 | 3383 | SEQ ID NO: 1998 | ctgttaggacaccagccct | 4054 | 4073 | 1 | 3 |
| SEQ ID NO: 996 | gactcaccctggacattca | 3382 | 3401 | SEQ ID NO: 1999 | tgaaattcaatcacaagtc | 9068 | 9087 | 1 | 3 |
| SEQ ID NO: 997 | ctggacattcagaacaaga | 3390 | 3409 | SEQ ID NO: 2000 | tcttttcttttcagcccag | 9218 | 9237 | 1 | 3 |
| SEQ ID NO: 998 | tcatgggcgacctaagttg | 3427 | 3446 | SEQ ID NO: 2001 | caactgcagacatatatga | 6627 | 6646 | 1 | 3 |
| SEQ ID NO: 999 | tgggcgacctaagttgtga | 3430 | 3449 | SEQ ID NO: 2002 | tcactccattaacctccca | 6308 | 6327 | 1 | 3 |
| SEQ ID NO: 1000 | agttgtgacacaaaggaag | 3441 | 3460 | SEQ ID NO: 2003 | cttcttttccaattgaact | 13830 | 13849 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 1001 | tgacacaaaggaagaaaga | 3446 | 3465 | SEQ ID NO: 2004 | tcttcatcttcatctgtca | 10212 | 10231 | 1 | 3 |
| SEQ ID NO: 1002 | gacacaaaggaagaaagaa | 3447 | 3466 | SEQ ID NO: 2005 | ttcttcatcttcatctgtc | 10211 | 10230 | 1 | 3 |
| SEQ ID NO: 1003 | ggaagaaagaaaatcaag | 3455 | 3474 | SEQ ID NO: 2006 | cttgtcatgcctacgttcc | 11340 | 11359 | 1 | 3 |
| SEQ ID NO: 2007 | aaaaagcgatggccgggtc | 3947 | 3966 | SEQ ID NO: 2313 | gaccttgcaagaatatttt | 6335 | 6354 | 1 | 3 |
| SEQ ID NO: 2008 | gtcaaatataccttgaaca | 3963 | 3982 | SEQ ID NO: 2314 | tgttaacaaattccttgac | 7355 | 7374 | 1 | 3 |
| SEQ ID NO: 2009 | tgaacaagaacagtttgaa | 3976 | 3995 | SEQ ID NO: 2315 | ttcaagttcctgaccttca | 8302 | 8321 | 1 | 3 |
| SEQ ID NO: 2010 | agtttgaaaattgagattc | 3987 | 4006 | SEQ ID NO: 2316 | gaatctggctccctcaact | 9039 | 9058 | 1 | 3 |
| SEQ ID NO: 2011 | gtttgaaaattgagattcc | 3988 | 4007 | SEQ ID NO: 2317 | ggaaataccaagtcaaaac | 10446 | 10465 | 1 | 3 |
| SEQ ID NO: 2012 | ttgaaaattgagattcctt | 3990 | 4009 | SEQ ID NO: 2318 | aaggaaaagcgcacctcaa | 12022 | 12041 | 1 | 3 |
| SEQ ID NO: 2013 | ctaaagatgttagagactg | 4038 | 4057 | SEQ ID NO: 2319 | cagttgaccacaagcttag | 10537 | 10556 | 1 | 3 |
| SEQ ID NO: 2014 | atgttagagactgttagga | 4044 | 4063 | SEQ ID NO: 2320 | tccttaacaccttccacat | 8065 | 8084 | 1 | 3 |
| SEQ ID NO: 2015 | cagccctccacttcaagtc | 4066 | 4085 | SEQ ID NO: 2321 | gacttctctagtcaggctg | 8805 | 8824 | 1 | 3 |
| SEQ ID NO: 2016 | agccctccacttcaagtct | 4067 | 4086 | SEQ ID NO: 2322 | agacatcgctgggctggct | 5720 | 5739 | 1 | 3 |
| SEQ ID NO: 2017 | ccatctgccatctcgagag | 4094 | 4113 | SEQ ID NO: 2323 | ctctcaaatgacatgatgg | 5322 | 5341 | 1 | 3 |
| SEQ ID NO: 2018 | attcccaagttgtatcaac | 4134 | 4153 | SEQ ID NO: 2324 | gttgagaagccccaagaat | 6246 | 6265 | 1 | 3 |
| SEQ ID NO: 2019 | tcaactgcaagtgcctctc | 4148 | 4167 | SEQ ID NO: 2325 | gagatcaagacactgttga | 8835 | 8854 | 1 | 3 |
| SEQ ID NO: 2020 | ggtgttctagacctctcca | 4170 | 4189 | SEQ ID NO: 2326 | tggaaccctctccctcacc | 4727 | 4746 | 1 | 3 |
| SEQ ID NO: 2021 | ctccacgaatgtctacagc | 4184 | 4203 | SEQ ID NO: 2327 | gctggtaacctaaaaggag | 5580 | 5599 | 1 | 3 |
| SEQ ID NO: 2022 | cacgaatgtctacagcaac | 4187 | 4206 | SEQ ID NO: 2328 | gttgccaccatcatcgtg | 11663 | 11682 | 1 | 3 |
| SEQ ID NO: 2023 | acgaatgtctacagcaact | 4188 | 4207 | SEQ ID NO: 2329 | agttgccaccatcatcgt | 11662 | 11681 | 1 | 3 |
| SEQ ID NO: 2024 | tcctacagtggtggcaaca | 4224 | 4243 | SEQ ID NO: 2330 | tgttagttgctcttaagga | 13351 | 13370 | 1 | 3 |
| SEQ ID NO: 2025 | cgttaccacatgaaggctg | 4272 | 4291 | SEQ ID NO: 2331 | cagcaagtacctgagaacg | 8603 | 8622 | 1 | 3 |
| SEQ ID NO: 2026 | gaaggctgactctgtggtt | 4283 | 4302 | SEQ ID NO: 2332 | aacctatgccttaatcttc | 13161 | 13180 | 1 | 3 |
| SEQ ID NO: 2027 | tgtggttgacctgctttcc | 4295 | 4314 | SEQ ID NO: 2333 | ggaaagttaaaacaacaca | 6957 | 6976 | 1 | 3 |
| SEQ ID NO: 2028 | cctgctttcctacaatgtg | 4304 | 4323 | SEQ ID NO: 2334 | cacaccttgacattgcagg | 11080 | 11099 | 1 | 3 |
| SEQ ID NO: 2029 | ctgctttcctacaatgtgc | 4305 | 4324 | SEQ ID NO: 2335 | gcacaccttgacattgcag | 11079 | 11098 | 1 | 3 |
| SEQ ID NO: 2030 | tcctacaatgtgcaaggat | 4311 | 4330 | SEQ ID NO: 2336 | atccgctggctctgaagga | 8569 | 8588 | 1 | 3 |
| SEQ ID NO: 2031 | tatgaccacaagaatacgt | 4344 | 4363 | SEQ ID NO: 2337 | acgtccgtgtgccttcata | 9976 | 9995 | 1 | 3 |
| SEQ ID NO: 2032 | atgaccacaagaatacgtc | 4345 | 4364 | SEQ ID NO: 2338 | gacgtccgtgtgccttcat | 9975 | 9994 | 1 | 3 |
| SEQ ID NO: 2033 | gaatacgtctacactatca | 4355 | 4374 | SEQ ID NO: 2339 | tgattatctgaattcattc | 6479 | 6498 | 1 | 3 |
| SEQ ID NO: 2034 | tttctagattcgaatatca | 4398 | 4417 | SEQ ID NO: 2340 | tgatttacatgatttgaaa | 6677 | 6696 | 1 | 3 |
| SEQ ID NO: 2035 | gattcgaatatcaaattca | 4404 | 4423 | SEQ ID NO: 2341 | tgaagtagctgagaaaatc | 7094 | 7113 | 1 | 3 |
| SEQ ID NO: 2036 | gaaacaacccagtctcaaa | 4441 | 4460 | SEQ ID NO: 2342 | tttgaaaattctcttttc | 9206 | 9225 | 1 | 3 |
| SEQ ID NO: 2037 | cccagtctcaaaaggttta | 4448 | 4467 | SEQ ID NO: 2343 | taaattcattactcctggg | 11294 | 11313 | 1 | 3 |
| SEQ ID NO: 2038 | ctcaaaaggtttactaata | 4454 | 4473 | SEQ ID NO: 2344 | tattcaaaactgagttgag | 12223 | 12242 | 1 | 3 |
| SEQ ID NO: 2039 | tcaaaaggtttactaatat | 4455 | 4474 | SEQ ID NO: 2345 | atattcaaaactgagttga | 12222 | 12241 | 1 | 3 |
| SEQ ID NO: 2040 | aaaaggtttactaatattc | 4457 | 4476 | SEQ ID NO: 2346 | gaatttgaaagttcgtttt | 9272 | 9291 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 2041 | gaaacagcatttgtttgtc | 4535 | 4554 | SEQ ID NO: 2347 | gacagcatcttcgtgtttc | 11206 | 11225 | 1 | 3 |
| SEQ ID NO: 2042 | atttgtttgtcaaagaagt | 4543 | 4562 | SEQ ID NO: 2348 | acttaaaaatataaaaat | 8014 | 8033 | 1 | 3 |
| SEQ ID NO: 2043 | tcaagattgatgggcagtt | 4561 | 4580 | SEQ ID NO: 2349 | aactctcaagtcaagttga | 13414 | 13433 | 1 | 3 |
| SEQ ID NO: 2044 | ttcagagtctcttcgttct | 4578 | 4597 | SEQ ID NO: 2350 | agaagatggcaaatttgaa | 11987 | 12006 | 1 | 3 |
| SEQ ID NO: 2045 | cagagtctcttcgttctat | 4580 | 4599 | SEQ ID NO: 2351 | atagcatggacttcttctg | 8865 | 8884 | 1 | 3 |
| SEQ ID NO: 2046 | atgctaaaggcacatatgg | 4597 | 4616 | SEQ ID NO: 2352 | ccatttgagatcacggcat | 9237 | 9256 | 1 | 3 |
| SEQ ID NO: 2047 | gcacatatggcctgtcttg | 4606 | 4625 | SEQ ID NO: 2353 | caagttggcaagtaagtgc | 9364 | 9383 | 1 | 3 |
| SEQ ID NO: 2048 | gagtccaacctgaggttta | 4659 | 4678 | SEQ ID NO: 2354 | taaagtgccacttttactc | 6182 | 6201 | 1 | 3 |
| SEQ ID NO: 2049 | agtccaacctgaggtttaa | 4660 | 4679 | SEQ ID NO: 2355 | ttaacagggaagatagact | 9300 | 9319 | 1 | 3 |
| SEQ ID NO: 2050 | cctacctccaaggcaccaa | 4684 | 4703 | SEQ ID NO: 2356 | ttggcaagtaagtgctagg | 9368 | 9387 | 1 | 3 |
| SEQ ID NO: 2051 | gaagatggaaccctctccc | 4722 | 4741 | SEQ ID NO: 2357 | gggaagaagaggcagcttc | 12283 | 12302 | 1 | 3 |
| SEQ ID NO: 2052 | tgatctgcaaagtggcatc | 4754 | 4773 | SEQ ID NO: 2358 | gatgaggaaactcagatca | 12255 | 12274 | 1 | 3 |
| SEQ ID NO: 2053 | gatctgcaaagtggcatca | 4755 | 4774 | SEQ ID NO: 2359 | tgatgaggaaactcagatc | 12254 | 12273 | 1 | 3 |
| SEQ ID NO: 2054 | gcttccctaaagtatgaga | 4785 | 4804 | SEQ ID NO: 2360 | tctcgtgtctaggaaaagc | 5969 | 5988 | 1 | 3 |
| SEQ ID NO: 2055 | gtatgagaactacgagctg | 4796 | 4815 | SEQ ID NO: 2361 | cagcttaagagacacatac | 6912 | 6931 | 1 | 3 |
| SEQ ID NO: 2056 | tctaacaagatggatatga | 4860 | 4879 | SEQ ID NO: 2362 | tcattttccaactaataga | 13024 | 13043 | 1 | 3 |
| SEQ ID NO: 2057 | ctgctgcgttctgaatatc | 4899 | 4918 | SEQ ID NO: 2363 | gatacaagaaaaactgcag | 6893 | 6912 | 1 | 3 |
| SEQ ID NO: 2058 | tcattgaggttcttcagcc | 4932 | 4951 | SEQ ID NO: 2364 | ggctcatatgctgaaatga | 5340 | 5359 | 1 | 3 |
| SEQ ID NO: 2059 | ttctggatcactaaattcc | 4955 | 4974 | SEQ ID NO: 2365 | ggaaggacaaggcccagaa | 12541 | 12560 | 1 | 3 |
| SEQ ID NO: 2060 | ccatggtcttgagttaaat | 4973 | 4992 | SEQ ID NO: 2366 | attttattcctgccatgg | 10095 | 10114 | 1 | 3 |
| SEQ ID NO: 2061 | tcttaggcactgacaaaat | 4999 | 5018 | SEQ ID NO: 2367 | attttttgcaagttaaaga | 14011 | 14030 | 1 | 3 |
| SEQ ID NO: 2062 | acaaggcgacactaaggat | 5032 | 5051 | SEQ ID NO: 2368 | atccatgatctacatttgt | 6786 | 6805 | 1 | 3 |
| SEQ ID NO: 2063 | tgcaacgaccaacttgaag | 5075 | 5094 | SEQ ID NO: 2369 | cttcagggaacacaatgca | 5177 | 5196 | 1 | 3 |
| SEQ ID NO: 2064 | caacttgaagtgtagtctc | 5084 | 5103 | SEQ ID NO: 2370 | gagatgagagatgccgttg | 6231 | 6250 | 1 | 3 |
| SEQ ID NO: 2065 | gctggagaatgagctgaat | 5108 | 5127 | SEQ ID NO: 2371 | attctcttttcttttcagc | 9214 | 9233 | 1 | 3 |
| SEQ ID NO: 2066 | gcagagcttggcctctctg | 5127 | 5146 | SEQ ID NO: 2372 | cagatacaagaaaaactgc | 6891 | 6910 | 1 | 3 |
| SEQ ID NO: 2067 | tctctggggcatctatgaa | 5140 | 5159 | SEQ ID NO: 2373 | ttcattcaattgggagaga | 6491 | 6510 | 1 | 3 |
| SEQ ID NO: 2068 | tctggggcatctatgaaat | 5142 | 5161 | SEQ ID NO: 2374 | atttgtaagaaaatacaga | 6428 | 6447 | 1 | 3 |
| SEQ ID NO: 2069 | aacacaatgcaaaattcag | 5185 | 5204 | SEQ ID NO: 2375 | ctgaagcattaaaactgtt | 7498 | 7517 | 1 | 3 |
| SEQ ID NO: 2070 | ctcacagagctatcactgg | 5223 | 5242 | SEQ ID NO: 2376 | ccagatgctgaacagtgag | 8141 | 8160 | 1 | 3 |
| SEQ ID NO: 2071 | tgggaagtgcttatcaggc | 5239 | 5258 | SEQ ID NO: 2377 | gcctacgttccatgtccca | 11348 | 11367 | 1 | 3 |
| SEQ ID NO: 2072 | ttcaaggtcagtcaagaag | 5295 | 5314 | SEQ ID NO: 2378 | cttcagtgcagaatatgaa | 11969 | 11988 | 1 | 3 |
| SEQ ID NO: 2073 | aatgacatgatgggctcat | 5328 | 5347 | SEQ ID NO: 2379 | atgattatctgaattcatt | 6478 | 6497 | 1 | 3 |
| SEQ ID NO: 2074 | gctcatatgctgaaatgaa | 5341 | 5360 | SEQ ID NO: 2380 | ttcagccattgacatgagc | 5738 | 5757 | 1 | 3 |
| SEQ ID NO: 2075 | atatgctgaaatgaaattt | 5345 | 5364 | SEQ ID NO: 2381 | aaatagctattgctaatat | 6694 | 6713 | 1 | 3 |
| SEQ ID NO: 2076 | tctgaacattgcaggctta | 5378 | 5397 | SEQ ID NO: 2382 | taagaaccagaagatcaga | 10988 | 11007 | 1 | 3 |
| SEQ ID NO: 2077 | gaacattgcaggcttatca | 5381 | 5400 | SEQ ID NO: 2383 | tgatatcgacgtgaggttc | 12482 | 12501 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 2078 | tgcaggcttatcactggac | 5387 | 5406 | SEQ ID NO: 2384 | gtcctggattccacatgca | 11844 | 11863 | 1 | 3 |
| SEQ ID NO: 2079 | tcaaaacttgacaacattt | 5412 | 5431 | SEQ ID NO: 2385 | aaattccttgacatgttga | 7362 | 7381 | 1 | 3 |
| SEQ ID NO: 2080 | atttacagctctgacaagt | 5427 | 5446 | SEQ ID NO: 2386 | acttaaaaatataaaaat | 8014 | 8033 | 1 | 3 |
| SEQ ID NO: 2081 | ctctgacaagttttataag | 5435 | 5454 | SEQ ID NO: 2387 | cttacttgaattccaagag | 10666 | 10685 | 1 | 3 |
| SEQ ID NO: 2082 | gttaatttacagctacagc | 5460 | 5479 | SEQ ID NO: 2388 | gctgcatgtggctggtaac | 5570 | 5589 | 1 | 3 |
| SEQ ID NO: 2083 | ttctctggtaactacttta | 5483 | 5502 | SEQ ID NO: 2389 | taaaagattactttgagaa | 7267 | 7286 | 1 | 3 |
| SEQ ID NO: 2084 | cctaaaaggagcctaccaa | 5588 | 5507 | SEQ ID NO: 2390 | ttggcaagtaagtgctagg | 9368 | 9387 | 1 | 3 |
| SEQ ID NO: 2085 | aaaaggagcctaccaaaat | 5591 | 5610 | SEQ ID NO: 2391 | atttacaattgttgctttt | 6263 | 6282 | 1 | 3 |
| SEQ ID NO: 2086 | aggagcctaccaaaataat | 5594 | 5613 | SEQ ID NO: 2392 | attacctatgatttctcct | 10119 | 10138 | 1 | 3 |
| SEQ ID NO: 2087 | ataatgaaataaaacacat | 5608 | 5627 | SEQ ID NO: 2393 | atgtcaaacactttgttat | 7057 | 7076 | 1 | 3 |
| SEQ ID NO: 2088 | aaaacacatctatgccatc | 5618 | 5637 | SEQ ID NO: 2394 | gatgaagatgacgacttt | 12150 | 12169 | 1 | 3 |
| SEQ ID NO: 2089 | tgctaaggttcagggtgtg | 5678 | 5697 | SEQ ID NO: 2395 | cacaagtcgattcccagca | 9079 | 9098 | 1 | 3 |
| SEQ ID NO: 2090 | gagtttagccatcggctca | 5697 | 5716 | SEQ ID NO: 2396 | tgaggtgactcagagactc | 7442 | 7461 | 1 | 3 |
| SEQ ID NO: 2091 | gctggcttcagccattgac | 5732 | 5751 | SEQ ID NO: 2397 | gtcagtgaagttctccagc | 8588 | 8607 | 1 | 3 |
| SEQ ID NO: 2092 | atttcagcaatgtcttccg | 5782 | 5801 | SEQ ID NO: 2398 | cggagcatgggagtgaaat | 8620 | 8639 | 1 | 3 |
| SEQ ID NO: 2093 | tttcagcaatgtcttccgt | 5783 | 5802 | SEQ ID NO: 2399 | acggagcatgggagtgaaa | 8619 | 8638 | 1 | 3 |
| SEQ ID NO: 2094 | ttcagcaatgtcttccgtt | 5784 | 5803 | SEQ ID NO: 2400 | aacggagcatgggagtgaa | 8618 | 8637 | 1 | 3 |
| SEQ ID NO: 2095 | cagcaatgtcttccgttct | 5786 | 5805 | SEQ ID NO: 2401 | agaagtgtcttcaaagctg | 12404 | 12423 | 1 | 3 |
| SEQ ID NO: 2096 | tgtcttccgttctgtaatg | 5792 | 5811 | SEQ ID NO: 2402 | cattcaattgggagagaca | 6493 | 6512 | 1 | 3 |
| SEQ ID NO: 2097 | gtcttccgttctgtaatgg | 5793 | 5812 | SEQ ID NO: 2403 | ccattcagtctctcaagac | 12967 | 12986 | 1 | 3 |
| SEQ ID NO: 2098 | atgggaaactcgctctctg | 5851 | 5870 | SEQ ID NO: 2404 | cagataaaaaactccaccat | 12205 | 12224 | 1 | 3 |
| SEQ ID NO: 2099 | ggagaacatactgggcagc | 5871 | 5890 | SEQ ID NO: 2405 | gctgttttgaagactctcc | 1080 | 1099 | 1 | 3 |
| SEQ ID NO: 2100 | gttgaaagcagaacctctg | 5906 | 5925 | SEQ ID NO: 2406 | cagaattcataatcccaac | 8266 | 8285 | 1 | 3 |
| SEQ ID NO: 2101 | gtctaggaaaagcatcagt | 5975 | 5994 | SEQ ID NO: 2407 | actgcaagattttcagac | 13604 | 13623 | 1 | 3 |
| SEQ ID NO: 2102 | agcatcagtgcagctcttg | 5985 | 6004 | SEQ ID NO: 2408 | caagaacctgttagttgct | 13343 | 13362 | 1 | 3 |
| SEQ ID NO: 2103 | ttgaacacaaagtcagtgc | 6001 | 6020 | SEQ ID NO: 2409 | gcacatcaatattgatcaa | 6410 | 6429 | 1 | 3 |
| SEQ ID NO: 2104 | gcagacaggcacctggaaa | 6038 | 6057 | SEQ ID NO: 2410 | tttcagatggcattgctgc | 11602 | 11621 | 1 | 3 |
| SEQ ID NO: 2105 | gaaactcaagacccaattt | 6053 | 6072 | SEQ ID NO: 2411 | aaatcccatccaggttttc | 8029 | 8048 | 1 | 3 |
| SEQ ID NO: 2106 | acaatgaatacagccagga | 6076 | 6095 | SEQ ID NO: 2412 | tcctttggctgtgctttgt | 9674 | 9693 | 1 | 3 |
| SEQ ID NO: 2107 | cttggatgcttacaacact | 6095 | 6114 | SEQ ID NO: 2413 | agtgaagttctccagcaag | 8591 | 8610 | 1 | 3 |
| SEQ ID NO: 2108 | ttggcgtggagcttactgg | 6124 | 6143 | SEQ ID NO: 2414 | ccagaattcataatccccaa | 8265 | 8284 | 1 | 3 |
| SEQ ID NO: 2109 | cacttttactcagtgagcc | 6190 | 6209 | SEQ ID NO: 2415 | ggctattgatgttagagtg | 6980 | 6999 | 1 | 3 |
| SEQ ID NO: 2110 | tttagagatgagagatgcc | 6227 | 6246 | SEQ ID NO: 2416 | ggcatgatgctcatttaaa | 9169 | 9188 | 1 | 3 |
| SEQ ID NO: 2111 | gagaagccccaagaattta | 6249 | 6268 | SEQ ID NO: 2417 | taaagccattcagtctctc | 12962 | 12981 | 1 | 3 |
| SEQ ID NO: 2112 | caattgttgcttttgtaaa | 6268 | 6287 | SEQ ID NO: 2418 | tttaaccagtcagatattg | 10179 | 10198 | 1 | 3 |
| SEQ ID NO: 2113 | ttttgtaaagtatgataaa | 6278 | 6297 | SEQ ID NO: 2419 | tttattgctgaatccaaaa | 13647 | 13666 | 1 | 3 |
| SEQ ID NO: 2114 | ttgtaaagtatgataaaaa | 6280 | 6299 | SEQ ID NO: 2420 | ttttgagaggaatcgacaa | 6350 | 6369 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 2115 | ttcactccattaacctccc | 6307 | 6326 | SEQ ID NO: 2421 | gggaaaaaacaggcttgaa | 9568 | 9587 | 1 | 3 |
| SEQ ID NO: 2116 | ttttgagaccttgcaagaa | 6329 | 6348 | SEQ ID NO: 2422 | ttctctctatgggaaaaaa | 9558 | 9577 | 1 | 3 |
| SEQ ID NO: 2117 | accttgcaagaatattttg | 6336 | 6355 | SEQ ID NO: 2423 | caaaagaagcccaagaggt | 12940 | 12959 | 1 | 3 |
| SEQ ID NO: 2118 | tcaatattgatcaatttgt | 6415 | 6434 | SEQ ID NO: 2424 | acaaagcagattatgttga | 11821 | 11840 | 1 | 3 |
| SEQ ID NO: 2119 | cagagcagccctgggaaaa | 6443 | 6462 | SEQ ID NO: 2425 | ttttcagaccaactctctg | 13614 | 13633 | 1 | 3 |
| SEQ ID NO: 2120 | cctgggaaaactcccacag | 6452 | 6471 | SEQ ID NO: 2426 | ctgtctctggtcagccagg | 7716 | 7735 | 1 | 3 |
| SEQ ID NO: 2121 | actcccacagcaagctaat | 6461 | 6480 | SEQ ID NO: 2427 | attacacttcctttcgagt | 12861 | 12880 | 1 | 3 |
| SEQ ID NO: 2122 | aattcattcaattgggaga | 6489 | 6508 | SEQ ID NO: 2428 | tctcttcctccatggaatt | 10471 | 10490 | 1 | 3 |
| SEQ ID NO: 2123 | ttcaattgggagagacaag | 6495 | 6514 | SEQ ID NO: 2429 | cttggagtgccagtttgaa | 11800 | 11819 | 1 | 3 |
| SEQ ID NO: 2124 | aggagaaactgactgctct | 6526 | 6545 | SEQ ID NO: 2430 | agagcttatgggatttcct | 11155 | 11174 | 1 | 3 |
| SEQ ID NO: 2125 | actgactgctctcacaaaa | 6533 | 6552 | SEQ ID NO: 2431 | ttttggcaagctatacagt | 8372 | 8391 | 1 | 3 |
| SEQ ID NO: 2126 | gactgctctcacaaaaaag | 6536 | 6555 | SEQ ID NO: 2432 | ctttgtgagtttatcagtc | 9687 | 9706 | 1 | 3 |
| SEQ ID NO: 2127 | cagacatatatgatacaat | 6633 | 6652 | SEQ ID NO: 2433 | attggatatccaagatctg | 1925 | 1944 | 1 | 3 |
| SEQ ID NO: 2128 | aatttgatcagtatattaa | 6849 | 6668 | SEQ ID NO: 2434 | ttaaaagaaatcttcaatt | 13807 | 13826 | 1 | 3 |
| SEQ ID NO: 2129 | tatgatttacatgatttga | 6675 | 6694 | SEQ ID NO: 2435 | tcaatgattatatcccata | 13120 | 13139 | 1 | 3 |
| SEQ ID NO: 2130 | tttgaaaatagctattgct | 6689 | 6708 | SEQ ID NO: 2436 | agcacagaaaaaattcaaa | 13856 | 13875 | 1 | 3 |
| SEQ ID NO: 2131 | ttgaaaatagctattgcta | 6690 | 6709 | SEQ ID NO: 2437 | tagcacagaaaaaattcaa | 13855 | 13874 | 1 | 3 |
| SEQ ID NO: 2132 | aatagctattgctaatatt | 6695 | 6714 | SEQ ID NO: 2438 | aataaatggagtctttatt | 14076 | 14095 | 1 | 3 |
| SEQ ID NO: 2133 | attattgatgaaatcattg | 6711 | 6730 | SEQ ID NO: 2439 | caataccagaattcataat | 8260 | 8279 | 1 | 3 |
| SEQ ID NO: 2134 | aaagtcttgatgagcacta | 6739 | 6758 | SEQ ID NO: 2440 | tagtgattacacttccttt | 12856 | 12875 | 1 | 3 |
| SEQ ID NO: 2135 | aagtcttgatgagcactat | 6740 | 6759 | SEQ ID NO: 2441 | atagcaacactaaatactt | 8761 | 8780 | 1 | 3 |
| SEQ ID NO: 2136 | ttgatgagcactatcatat | 6745 | 6764 | SEQ ID NO: 2442 | atatccaagatgagatcaa | 13093 | 13112 | 1 | 3 |
| SEQ ID NO: 2137 | taattttagtaaaaacaat | 6769 | 6788 | SEQ ID NO: 2443 | attgagattccctccatta | 11694 | 11713 | 1 | 3 |
| SEQ ID NO: 2138 | ttttagtaaaaacaatcca | 6772 | 6791 | SEQ ID NO: 2444 | tggagtgccagtttgaaaa | 11802 | 11821 | 1 | 3 |
| SEQ ID NO: 2139 | acatttgtttattgaaaat | 6797 | 6816 | SEQ ID NO: 2445 | atttcctaaagctggatgt | 11167 | 11186 | 1 | 3 |
| SEQ ID NO: 2140 | attgattttaacaaaagtg | 6816 | 6835 | SEQ ID NO: 2446 | cactgttccagttgtcaat | 9863 | 9882 | 1 | 3 |
| SEQ ID NO: 2141 | attttaacaaaagtggaag | 6820 | 6839 | SEQ ID NO: 2447 | cttaaaagacttaaaaaat | 8006 | 8025 | 1 | 3 |
| SEQ ID NO: 2142 | aaatcagaatccagataca | 6880 | 6899 | SEQ ID NO: 2448 | tgtaccataagccatattt | 10080 | 10099 | 1 | 3 |
| SEQ ID NO: 2143 | gaatccagatacaagaaaa | 6886 | 6905 | SEQ ID NO: 2449 | ttttctaaacttgaaattc | 9057 | 9076 | 1 | 3 |
| SEQ ID NO: 2144 | ttaagagacacatacagaa | 6916 | 6935 | SEQ ID NO: 2450 | ttcttaaacattcctttaa | 9483 | 9502 | 1 | 3 |
| SEQ ID NO: 2145 | atccagcacctagctggaa | 6942 | 6961 | SEQ ID NO: 2451 | ttccaatttccctgtggat | 3680 | 3699 | 1 | 3 |
| SEQ ID NO: 2146 | tgagcatgtcaaacacttt | 7052 | 7071 | SEQ ID NO: 2452 | aaagtgccacttttactca | 6183 | 6202 | 1 | 3 |
| SEQ ID NO: 2147 | gagcatgtcaaacactttg | 7053 | 7072 | SEQ ID NO: 2453 | caaatgacatgatgggctc | 5326 | 5345 | 1 | 3 |
| SEQ ID NO: 2148 | aaacactttgttataaatc | 7062 | 7081 | SEQ ID NO: 2454 | gattatatcccatatgttt | 13125 | 13144 | 1 | 3 |
| SEQ ID NO: 2149 | tgagaaaatcaatgccttc | 7103 | 7122 | SEQ ID NO: 2455 | gaaggaaaagcgcacctca | 12021 | 12040 | 1 | 3 |
| SEQ ID NO: 2150 | tatgaagtagaccaacaaa | 7152 | 7171 | SEQ ID NO: 2456 | tttgtggagggtagtcata | 10323 | 10342 | 1 | 3 |
| SEQ ID NO: 2151 | aagtagaccaacaaatcca | 7156 | 7175 | SEQ ID NO: 2457 | tggatgaagatgacgactt | 12148 | 12167 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 2152 | aagttgaaggagactattc | 7215 | 7234 | SEQ ID NO: 2458 | gaataccaatgctgaactt | 10160 | 10179 | 1 | 3 |
| SEQ ID NO: 2153 | acaagttaagataaaagat | 7256 | 7275 | SEQ ID NO: 2459 | atctaaattcagttcttgt | 11326 | 11345 | 1 | 3 |
| SEQ ID NO: 2154 | aagataaaagattactttg | 7263 | 7282 | SEQ ID NO: 2460 | caaaatagaagggaatctt | 2069 | 2088 | 1 | 3 |
| SEQ ID NO: 2155 | gattactttgagaaattag | 7272 | 7291 | SEQ ID NO: 2461 | ctaaacttgaaattcaatc | 9061 | 9080 | 1 | 3 |
| SEQ ID NO: 2156 | tgagaaattagttggattt | 7280 | 7299 | SEQ ID NO: 2462 | aaatccgtgaggtgactca | 7435 | 7454 | 1 | 3 |
| SEQ ID NO: 2157 | aaattagttggatttattg | 7284 | 7303 | SEQ ID NO: 2463 | caattttgagaatgaattt | 10411 | 10430 | 1 | 3 |
| SEQ ID NO: 2158 | tggatttattgatgatgct | 7292 | 7311 | SEQ ID NO: 2464 | agcatgcctagtttctcca | 9945 | 9964 | 1 | 3 |
| SEQ ID NO: 2159 | tcattgaagatgttaacaa | 7345 | 7364 | SEQ ID NO: 2465 | ttgtagatgaaaccaatga | 7414 | 7433 | 1 | 3 |
| SEQ ID NO: 2160 | cattgaagatgttaacaaa | 7346 | 7365 | SEQ ID NO: 2466 | tttgtagatgaaaccaatg | 7413 | 7432 | 1 | 3 |
| SEQ ID NO: 2161 | attgaagatgttaacaaat | 7347 | 7366 | SEQ ID NO: 2467 | atttaagtatgatttcaat | 10487 | 10506 | 1 | 3 |
| SEQ ID NO: 2162 | ttgaagatgttaacaaatt | 7348 | 7367 | SEQ ID NO: 2468 | aatttaagtatgatttcaa | 10486 | 10505 | 1 | 3 |
| SEQ ID NO: 2163 | tgaagatgttaacaaattc | 7349 | 7368 | SEQ ID NO: 2469 | gaatttaagtatgatttca | 10485 | 10504 | 1 | 3 |
| SEQ ID NO: 2164 | acatgttgataaagaaatt | 7372 | 7391 | SEQ ID NO: 2470 | aattccctgaagttgatgt | 11479 | 11498 | 1 | 3 |
| SEQ ID NO: 2165 | tttgattaccaccagtttg | 7398 | 7417 | SEQ ID NO: 2471 | caaattgaacatccccaaa | 8783 | 8802 | 1 | 3 |
| SEQ ID NO: 2166 | caaaatccgtgaggtgact | 7433 | 7452 | SEQ ID NO: 2472 | agtcccctaacagatttg | 7964 | 7983 | 1 | 3 |
| SEQ ID NO: 2167 | aaaatccgtgaggtgactc | 7434 | 7453 | SEQ ID NO: 2473 | gagtgaaatgctgtttttt | 8630 | 8649 | 1 | 3 |
| SEQ ID NO: 2168 | aggtgactcagagactcaa | 7444 | 7463 | SEQ ID NO: 2474 | ttgatgatatctggaacct | 10723 | 10742 | 1 | 3 |
| SEQ ID NO: 2169 | gtgaaattcaggctctgga | 7465 | 7484 | SEQ ID NO: 2475 | tccaatctcctcttttcac | 8401 | 8420 | 1 | 3 |
| SEQ ID NO: 2170 | gttgcagtgtatctggaaa | 7539 | 7558 | SEQ ID NO: 2476 | tttcaagcaaatgcacaac | 8532 | 8551 | 1 | 3 |
| SEQ ID NO: 2171 | ttaagttcagcatctttgg | 7608 | 7627 | SEQ ID NO: 2477 | ccaatgctgaactttttaa | 10165 | 10184 | 1 | 3 |
| SEQ ID NO: 2172 | tgaaggccaaattccgaga | 7633 | 7852 | SEQ ID NO: 2478 | tctcctttcttcatcttca | 10205 | 10224 | 1 | 3 |
| SEQ ID NO: 2173 | aatgtatcaaatggacatt | 7676 | 7695 | SEQ ID NO: 2479 | aatgaagtccggattcatt | 11013 | 11032 | 1 | 3 |
| SEQ ID NO: 2174 | attcagcaggaacttcaac | 7692 | 7711 | SEQ ID NO: 2480 | gttgagaagccccaagaat | 6246 | 6265 | 1 | 3 |
| SEQ ID NO: 2175 | acctgtctctggtcagcca | 7714 | 7733 | SEQ ID NO: 2481 | tggcaagtaagtgctaggt | 9369 | 9388 | 1 | 3 |
| SEQ ID NO: 2176 | cctgtctctggtcagccag | 7715 | 7734 | SEQ ID NO: 2482 | ctggacttctctagtcagg | 8802 | 8821 | 1 | 3 |
| SEQ ID NO: 2177 | ggtcagccaggtttatagc | 7724 | 7743 | SEQ ID NO: 2483 | gctaaaggagcagttgacc | 10527 | 10546 | 1 | 3 |
| SEQ ID NO: 2178 | ccaggtttatagcacactt | 7730 | 7749 | SEQ ID NO: 2484 | aagtccggattcattctgg | 11017 | 11036 | 1 | 3 |
| SEQ ID NO: 2179 | gtttatagcacacttgtca | 7734 | 7753 | SEQ ID NO: 2485 | tgacctgtccattcaaaac | 13673 | 13692 | 1 | 3 |
| SEQ ID NO: 2180 | acttgtcacctacatttct | 7745 | 7764 | SEQ ID NO: 2486 | agaaaaggggattgaagt | 10275 | 10294 | 1 | 3 |
| SEQ ID NO: 2181 | ctgattggtggactcttgc | 7762 | 7781 | SEQ ID NO: 2487 | gcaagttaaagaaaatcag | 14018 | 14037 | 1 | 3 |
| SEQ ID NO: 2182 | atgaaagcattggtagagc | 7839 | 7858 | SEQ ID NO: 2488 | gctcatctcctttcttcat | 10200 | 10219 | 1 | 3 |
| SEQ ID NO: 2183 | tgaaagcattggtagagca | 7840 | 7859 | SEQ ID NO: 2489 | tgctcatctcctttcttca | 10199 | 10218 | 1 | 3 |
| SEQ ID NO: 2184 | gggttcactgttcctgaaa | 7860 | 7879 | SEQ ID NO: 2490 | tttcaccatagaaggaccc | 8951 | 8970 | 1 | 3 |
| SEQ ID NO: 2185 | tcaagaccatccttgggac | 7879 | 7898 | SEQ ID NO: 2491 | gtcccctaacagatttga | 7965 | 7984 | 1 | 3 |
| SEQ ID NO: 2186 | ccttgggaccatgcctgcc | 7889 | 7908 | SEQ ID NO: 2492 | ggcaccagggctcggaagg | 13970 | 13989 | 1 | 3 |
| SEQ ID NO: 2187 | ttcaggctcttcagaaagc | 7921 | 7940 | SEQ ID NO: 2493 | gcttgaaggaattcttgaa | 9580 | 9599 | 1 | 3 |
| SEQ ID NO: 2188 | ttcagataaacttcaaaga | 7996 | 8015 | SEQ ID NO: 2494 | tcttcataagttcaatgaa | 13175 | 13194 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 2189 | acttcaaagacttaaaaaa | 8005 | 8024 | SEQ ID NO: 2495 | ttttaacaaaagtggaagt | 6821 | 6840 | 1 | 3 |
| SEQ ID NO: 2190 | atcccatccaggttttcca | 8031 | 8050 | SEQ ID NO: 2496 | tggagaagcaaatctggat | 9464 | 9483 | 1 | 3 |
| SEQ ID NO: 2191 | gaatttaccatccttaaca | 8055 | 8074 | SEQ ID NO: 2497 | tgttgaagtgtctccattc | 9881 | 9900 | 1 | 3 |
| SEQ ID NO: 2192 | cattccttcctttacaatt | 8081 | 8100 | SEQ ID NO: 2498 | aattccaattttgagaatg | 10406 | 10425 | 1 | 3 |
| SEQ ID NO: 2193 | ttgaccagatgctgaacag | 8137 | 8156 | SEQ ID NO: 2499 | ctgttgaaagatttatcaa | 12924 | 12943 | 1 | 3 |
| SEQ ID NO: 2194 | aatcaccctgccagacttc | 8225 | 8244 | SEQ ID NO: 2500 | gaagttctcaattttgatt | 8514 | 8533 | 1 | 3 |
| SEQ ID NO: 2195 | tgaccttcacataccagaa | 8312 | 8331 | SEQ ID NO: 2501 | ttcttctggaaaagggtca | 8876 | 8895 | 1 | 3 |
| SEQ ID NO: 2196 | ttccagcttccccacatct | 8331 | 8350 | SEQ ID NO: 2502 | agattctcagatgagggaa | 8913 | 8932 | 1 | 3 |
| SEQ ID NO: 2197 | aagctatacagtattctga | 8379 | 8398 | SEQ ID NO: 2503 | tcagatggcattgctgctt | 11604 | 11623 | 1 | 3 |
| SEQ ID NO: 2198 | attctgaaaatccaatctc | 8391 | 8410 | SEQ ID NO: 2504 | gagataaccgtgcctgaat | 11544 | 11563 | 1 | 3 |
| SEQ ID NO: 2199 | tttcacattagatgcaaat | 8414 | 8433 | SEQ ID NO: 2505 | attttgaaaaaaacagaaa | 9730 | 9749 | 1 | 3 |
| SEQ ID NO: 2200 | caaatgctgacataggaaa | 8428 | 8447 | SEQ ID NO: 2506 | ttccatcacaaatcctttg | 9662 | 9681 | 1 | 3 |
| SEQ ID NO: 2201 | gagagtccaaattagaagt | 8500 | 8519 | SEQ ID NO: 2507 | actttacttcccaactctc | 13402 | 13421 | 1 | 3 |
| SEQ ID NO: 2202 | agagtccaaattagaagtt | 8501 | 8520 | SEQ ID NO: 2508 | aactttacttcccaactct | 13401 | 13420 | 1 | 3 |
| SEQ ID NO: 2203 | tctcaattttgattttcaa | 8519 | 8538 | SEQ ID NO: 2509 | ttgattccctttttgaga | 11529 | 11548 | 1 | 3 |
| SEQ ID NO: 2204 | caattttgattttcaagca | 8522 | 8541 | SEQ ID NO: 2510 | tgctgaatccaaaagattg | 13652 | 13671 | 1 | 3 |
| SEQ ID NO: 2205 | aatgcacaactctcaaacc | 8541 | 8560 | SEQ ID NO: 2511 | ggtttatcaaggggccatt | 12452 | 12471 | 1 | 3 |
| SEQ ID NO: 2206 | agttctccagcaagtacct | 8596 | 8615 | SEQ ID NO: 2512 | aggttccatcgtgcaaact | 11380 | 11399 | 1 | 3 |
| SEQ ID NO: 2207 | agtacctgagaacggagca | 8608 | 8627 | SEQ ID NO: 2513 | tgctccaggagaacttact | 13772 | 13791 | 1 | 3 |
| SEQ ID NO: 2208 | tcaaacacagtggcaagtt | 8670 | 8689 | SEQ ID NO: 2514 | aactctcaagtcaagttga | 13414 | 13433 | 1 | 3 |
| SEQ ID NO: 2209 | acaatcagcttaccctgga | 8743 | 8762 | SEQ ID NO: 2515 | tccattctgaatatattgt | 13372 | 13391 | 1 | 3 |
| SEQ ID NO: 2210 | ctggatagcaacactaaat | 8757 | 8776 | SEQ ID NO: 2516 | attttctgaacttccccag | 12694 | 12713 | 1 | 3 |
| SEQ ID NO: 2211 | ctgacctgcgcaacgagat | 8821 | 8840 | SEQ ID NO: 2517 | atctgatgaggaaactcag | 12251 | 12270 | 1 | 3 |
| SEQ ID NO: 2212 | agatgagggaacacatgaa | 8921 | 8940 | SEQ ID NO: 2518 | ttcatgtccctagaaatct | 10030 | 10049 | 1 | 3 |
| SEQ ID NO: 2213 | tcaacttttctaaacttga | 9052 | 9071 | SEQ ID NO: 2519 | tcaaggataacgtgtttga | 12610 | 12629 | 1 | 3 |
| SEQ ID NO: 2214 | ttctaaacttgaaattcaa | 9059 | 9078 | SEQ ID NO: 2520 | ttgatgatgctgtcaagaa | 7300 | 7319 | 1 | 3 |
| SEQ ID NO: 2215 | gaaattcaatcacaagtcg | 9069 | 9088 | SEQ ID NO: 2521 | cgacgaagaaaataatttc | 13558 | 13577 | 1 | 3 |
| SEQ ID NO: 2216 | cactgtttggagaagggaa | 9133 | 9152 | SEQ ID NO: 2522 | ttccagaaagcagccagtg | 12498 | 12517 | 1 | 3 |
| SEQ ID NO: 2217 | actgtttggagaagggaag | 9134 | 9153 | SEQ ID NO: 2523 | cttccccaaagagaccagt | 2890 | 2909 | 1 | 3 |
| SEQ ID NO: 2218 | aattctcttttcttttcag | 9213 | 9232 | SEQ ID NO: 2524 | ctgattactatgaaaaatt | 13630 | 13649 | 1 | 3 |
| SEQ ID NO: 2219 | ttcttttcagcccagccat | 9222 | 9241 | SEQ ID NO: 2525 | atggaaagggaaagagaa | 13486 | 13505 | 1 | 3 |
| SEQ ID NO: 2220 | tttgaaagttcgttttcca | 9275 | 9294 | SEQ ID NO: 2526 | tggaagtgtcagtggcaaa | 10372 | 10391 | 1 | 3 |
| SEQ ID NO: 2221 | cagggaagataggcttcct | 9304 | 9323 | SEQ ID NO: 2527 | aggacctttcaaattcctg | 9840 | 9859 | 1 | 3 |
| SEQ ID NO: 2222 | ataagtacaaccaaaattt | 9397 | 9416 | SEQ ID NO: 2528 | aaatcaggatctgagttat | 14030 | 14049 | 1 | 3 |
| SEQ ID NO: 2223 | acaacgagaacattatgga | 9427 | 9446 | SEQ ID NO: 2529 | tccattctgaatatattgt | 13372 | 13391 | 1 | 3 |
| SEQ ID NO: 2224 | aggaataaatggagaagca | 9455 | 9474 | SEQ ID NO: 2530 | tgctggaattgtcattcct | 11726 | 11745 | 1 | 3 |
| SEQ ID NO: 2225 | agcaaatctggatttctta | 9470 | 9489 | SEQ ID NO: 2531 | taagttctctgtacctgct | 11711 | 11730 | 1 | 3 |

TABLE 8-continued

Selected palindromic sequences from human ApoB

| Source | | Start Index | End Index | Match | | Start Index | End Index | # | B |
|---|---|---|---|---|---|---|---|---|---|
| SEQ ID NO: 2226 | tcctttaacaattcctgaa | 9494 | 9513 | SEQ ID NO: 2532 | ttcaaaacgagcttcagga | 13198 | 13217 | 1 | 3 |
| SEQ ID NO: 2227 | tttaacaattcctgaaatg | 9497 | 9516 | SEQ ID NO: 2533 | catttgatttaagtgtaaa | 9613 | 9632 | 1 | 3 |
| SEQ ID NO: 2228 | acacaataatcacaactcc | 9526 | 9545 | SEQ ID NO: 2534 | ggagacagcatcttcgtgt | 11203 | 11222 | 1 | 3 |
| SEQ ID NO: 2229 | aagatttctctctatggga | 9553 | 9572 | SEQ ID NO: 2535 | tcccagaaaacctcttctt | 3928 | 3947 | 1 | 3 |
| SEQ ID NO: 2230 | gaaaaaacaggcttgaagg | 9570 | 9589 | SEQ ID NO: 2536 | ccttttacaattcattttc | 13013 | 13032 | 1 | 3 |
| SEQ ID NO: 2231 | ttgaaggaattcttgaaaa | 9582 | 9601 | SEQ ID NO: 2537 | ttttgagaatgaatttcaa | 10414 | 10433 | 1 | 3 |
| SEQ ID NO: 2232 | tgaaggaattcttgaaaac | 9583 | 9602 | SEQ ID NO: 2538 | gttttggctgataaattca | 11283 | 11302 | 1 | 3 |
| SEQ ID NO: 2233 | agctcagtataagaaaaac | 9632 | 9651 | SEQ ID NO: 2539 | gtttgataagtacaaagct | 9797 | 9816 | 1 | 3 |
| SEQ ID NO: 2234 | tcaaatcctttgacaggca | 9712 | 9731 | SEQ ID NO: 2540 | tgcctgagcagaccattga | 11680 | 11699 | 1 | 3 |
| SEQ ID NO: 2235 | atgaaacaaaaattaagtt | 9781 | 9800 | SEQ ID NO: 2541 | aactttgcactatgttcat | 12754 | 12773 | 1 | 3 |
| SEQ ID NO: 2236 | aattcctggatacactgtt | 9851 | 9870 | SEQ ID NO: 2542 | aacacatgaatcacaaatt | 8930 | 8949 | 1 | 3 |
| SEQ ID NO: 2237 | ttccagttgtcaatgttga | 9868 | 9887 | SEQ ID NO: 2543 | tcaaaacgagcttcaggaa | 13199 | 13218 | 1 | 3 |
| SEQ ID NO: 2238 | aagtgtctccattccaccat | 9886 | 9905 | SEQ ID NO: 2544 | atgggaagtataagaactt | 4834 | 4853 | 1 | 3 |
| SEQ ID NO: 2239 | gtcagcatgcctagtttct | 9942 | 9961 | SEQ ID NO: 2545 | agaaaaggcacaccttgac | 11072 | 11091 | 1 | 3 |
| SEQ ID NO: 2240 | ctgccatgggcaatattac | 10105 | 10124 | SEQ ID NO: 2546 | gtaagaaaatacagagcag | 6432 | 6451 | 1 | 3 |
| SEQ ID NO: 2241 | tgaataccaatgctgaact | 10159 | 10178 | SEQ ID NO: 2547 | agttgaaggagactattca | 7216 | 7235 | 1 | 3 |
| SEQ ID NO: 2242 | tattgttgctcatctcctt | 10193 | 10212 | SEQ ID NO: 2548 | aaggaaacataaactaata | 12881 | 12900 | 1 | 3 |
| SEQ ID NO: 2243 | tgttgctcatctcctttct | 10196 | 10215 | SEQ ID NO: 2549 | agaagaaatctgcagaaca | 12423 | 12442 | 1 | 3 |
| SEQ ID NO: 2244 | tctgtcattgatgcactgc | 10224 | 10243 | SEQ ID NO: 2550 | gcagtagactataagcaga | 13920 | 13939 | 1 | 3 |
| SEQ ID NO: 2245 | ccacagctctgtctctgag | 10297 | 10316 | SEQ ID NO: 2551 | ctcagggatctgaaggtgg | 8187 | 8206 | 1 | 3 |
| SEQ ID NO: 2246 | atttgtggagggtagtcat | 10322 | 10341 | SEQ ID NO: 2552 | atgaagtagaccaacaaat | 7153 | 7172 | 1 | 3 |
| SEQ ID NO: 2247 | atatggaagtgtcagtggc | 10369 | 10388 | SEQ ID NO: 2553 | gccacactccaacgcatat | 10770 | 10789 | 1 | 3 |
| SEQ ID NO: 2248 | tggaaataccaagtcaaaa | 10445 | 10464 | SEQ ID NO: 2554 | ttttacaattcattttcca | 13015 | 13034 | 1 | 3 |
| SEQ ID NO: 2249 | aagtcaaaacctactgtct | 10455 | 10474 | SEQ ID NO: 2555 | agacctagtgattacactt | 12851 | 12870 | 1 | 3 |
| SEQ ID NO: 2250 | actgtctcttcctccatgg | 10467 | 10486 | SEQ ID NO: 2556 | ccatgcaagtcagcccagt | 10916 | 10935 | 1 | 3 |
| SEQ ID NO: 2251 | cttcctccatggaatttaa | 10474 | 10493 | SEQ ID NO: 2557 | ttaatcgagaggtatgaag | 7140 | 7159 | 1 | 3 |
| SEQ ID NO: 2252 | attcttcaatgctgtactc | 10504 | 10523 | SEQ ID NO: 2558 | gagttgagggtccgggaat | 12234 | 12253 | 1 | 3 |
| SEQ ID NO: 2253 | ttgaccacaagcftagctt | 10540 | 10559 | SEQ ID NO: 2559 | aagcgcacctcaatatcaa | 12028 | 12047 | 1 | 3 |
| SEQ ID NO: 2254 | cctcacctcttacttttcc | 10565 | 10584 | SEQ ID NO: 2560 | ggaactattgctagtgagg | 10641 | 10660 | 1 | 3 |
| SEQ ID NO: 2255 | agctgcagggcacttccaa | 10702 | 10721 | SEQ ID NO: 2561 | ttgggaagaagaggcagct | 12281 | 12300 | 1 | 3 |
| SEQ ID NO: 2256 | ttccaaaattgatgatatc | 10715 | 10734 | SEQ ID NO: 2582 | gatatacactagggaggaa | 12737 | 12756 | 1 | 3 |
| SEQ ID NO: 2257 | gagaacatacaagcaaagc | 10852 | 10871 | SEQ ID NO: 2563 | gcttggttttgccagtctc | 2459 | 2478 | 1 | 3 |
| SEQ ID NO: 2258 | atggcaaatgtcagctctt | 10889 | 10908 | SEQ ID NO: 2564 | aagaggtatttaaagccat | 12952 | 12971 | 1 | 3 |
| SEQ ID NO: 2259 | tggcaaatgtcagctcttg | 10890 | 10909 | SEQ ID NO: 2565 | caagaggtatttaaagcca | 12951 | 12970 | 1 | 3 |
| SEQ ID NO: 2260 | ttgttcaggtccatgcaag | 10906 | 10925 | SEQ ID NO: 2566 | cttggggaggaggaacaa | 14058 | 14077 | 1 | 3 |
| SEQ ID NO: 2261 | tgttcaggtccatgcaagt | 10907 | 10926 | SEQ ID NO: 2557 | acttggggaggaggaaca | 14057 | 14076 | 1 | 3 |
| SEQ ID NO: 2262 | agttccttccatgatttcc | 10932 | 10951 | SEQ ID NO: 2568 | ggaatctgatgaggaaact | 12248 | 12267 | 1 | 3 |

TABLE 8-continued

Selected palindromic sequences from human ApoB

| | Source | Start Index | End Index | | Match | Start Index | End Index | # | B |
|---|---|---|---|---|---|---|---|---|---|
| SEQ ID NO: 2263 | tgctaacactaagaaccag | 10979 | 10998 | SEQ ID NO: 2569 | ctggatgtaaccaccagca | 11178 | 11197 | 1 | 3 |
| SEQ ID NO: 2264 | actaagaaccagaagatca | 10986 | 11005 | SEQ ID NO: 2570 | tgatcaagaacctgttagt | 13339 | 13358 | 1 | 3 |
| SEQ ID NO: 2265 | ctaagaaccagaagatcag | 10987 | 11006 | SEQ ID NO: 2571 | ctgatcaagaacctgttag | 13338 | 13357 | 1 | 3 |
| SEQ ID NO: 2266 | cagaagatcagatggaaaa | 10995 | 11014 | SEQ ID NO: 2572 | ttttcagaccaactctctg | 13614 | 13633 | 1 | 3 |
| SEQ ID NO: 2267 | aaaaatgaagtccggattc | 11010 | 11029 | SEQ ID NO: 2573 | gaatttgaaagttcgtttt | 9272 | 9291 | 1 | 3 |
| SEQ ID NO: 2268 | gattcattctgggtctttc | 11024 | 11043 | SEQ ID NO: 2574 | gaaaacctatgccttaatc | 13158 | 13177 | 1 | 3 |
| SEQ ID NO: 2269 | aagaaaaggcacaccttga | 11071 | 11090 | SEQ ID NO: 2575 | tcaaaacctactgtctctt | 10458 | 10477 | 1 | 3 |
| SEQ ID NO: 2270 | aaggacacctaaggttcct | 11107 | 11126 | SEQ ID NO: 2576 | aggacaccaaaataacctt | 7564 | 7583 | 1 | 3 |
| SEQ ID NO: 2271 | ccagcattggtaggagaca | 11191 | 11210 | SEQ ID NO: 2577 | tgtcaacaagtaccactgg | 12362 | 12381 | 1 | 3 |
| SEQ ID NO: 2272 | ctttgtgtacaccaaaaac | 11231 | 11250 | SEQ ID NO: 2578 | gttttttaaattgttgaaag | 13140 | 13159 | 1 | 3 |
| SEQ ID NO: 2273 | ccatccctgtaaaagtttt | 11269 | 11288 | SEQ ID NO: 2579 | aaagggtcatgggaaatgg | 8885 | 8904 | 1 | 3 |
| SEQ ID NO: 2274 | tgatctaaattcagttctt | 11324 | 11343 | SEQ ID NO: 2580 | aagatagtcagtctgatca | 13326 | 13345 | 1 | 3 |
| SEQ ID NO: 2275 | aagaagctgagaaacttcat | 11424 | 11443 | SEQ ID NO: 2581 | atgagatcaacacaatctt | 13102 | 13121 | 1 | 3 |
| SEQ ID NO: 2276 | tttgccctcaacctaccaa | 11445 | 11464 | SEQ ID NO: 2582 | ttggtacgagttactcaaa | 12633 | 12652 | 1 | 3 |
| SEQ ID NO: 2277 | cttgattcccttttttgag | 11528 | 11547 | SEQ ID NO: 2583 | ctcaattttgattttcaag | 8520 | 8539 | 1 | 3 |
| SEQ ID NO: 2278 | ttcacgcttccaaaaagtg | 11583 | 11602 | SEQ ID NO: 2584 | cactcattgattttctgaa | 12685 | 12704 | 1 | 3 |
| SEQ ID NO: 2279 | tgtttcagatggcattgct | 11600 | 11519 | SEQ ID NO: 2585 | agcagattatgttgaaaca | 11825 | 11844 | 1 | 3 |
| SEQ ID NO: 2280 | aatgcagtagccaacaaga | 11631 | 11650 | SEQ ID NO: 2586 | tcttttcagcccagccatt | 9223 | 9242 | 1 | 3 |
| SEQ ID NO: 2281 | ctgagcagaccattgagat | 11683 | 11702 | SEQ ID NO: 2587 | atctgatgaggaaactcag | 12251 | 12270 | 1 | 3 |
| SEQ ID NO: 2282 | tgagcagaccattgagatt | 11684 | 11703 | SEQ ID NO: 2588 | aatctgatgaggaaactca | 12250 | 12269 | 1 | 3 |
| SEQ ID NO: 2283 | ttgagattccctccattaa | 11695 | 11714 | SEQ ID NO: 2589 | ttaatcttcataagttcaa | 13171 | 13190 | 1 | 3 |
| SEQ ID NO: 2284 | acttggagtgccagtttga | 11799 | 11818 | SEQ ID NO: 2590 | tcaattgggagagacaagt | 6496 | 6515 | 1 | 3 |
| SEQ ID NO: 2285 | caaatttgaaggacttcag | 11996 | 12015 | SEQ ID NO: 2591 | ctgagaacttcatcatttg | 11430 | 11449 | 1 | 3 |
| SEQ ID NO: 2286 | agcccagcgttcaccgatc | 12048 | 12067 | SEQ ID NO: 2592 | gatccaagtatagttggct | 13278 | 13297 | 1 | 3 |
| SEQ ID NO: 2287 | cagcgttcaccgatctcca | 12052 | 12071 | SEQ ID NO: 2593 | tggacctgcaccaaagctg | 13952 | 13971 | 1 | 3 |
| SEQ ID NO: 2288 | ctccatctgcgctaccaga | 12066 | 12085 | SEQ ID NO: 2594 | tctgatatacatcacggag | 13703 | 13722 | 1 | 3 |
| SEQ ID NO: 2289 | atgaggaaactcagatcaa | 12256 | 12275 | SEQ ID NO: 2595 | ttgagttgcccaccatcat | 11659 | 11678 | 1 | 3 |
| SEQ ID NO: 2290 | aggcagcttctggcttgct | 12292 | 12311 | SEQ ID NO: 2596 | agcaagtctttcctggcct | 3010 | 3029 | 1 | 3 |
| SEQ ID NO: 2291 | tgaaagacaacgtgcccaa | 12319 | 12338 | SEQ ID NO: 2597 | ttgggagagacaagtttca | 6500 | 6519 | 1 | 3 |
| SEQ ID NO: 2292 | tatgattatgtcaacaagt | 12354 | 12373 | SEQ ID NO: 2598 | actttgcactatgttcata | 12755 | 12774 | 1 | 3 |
| SEQ ID NO: 2293 | cattaggcaaattgatgat | 12467 | 12486 | SEQ ID NO: 2599 | atcaacacaatcttcaatg | 13107 | 13126 | 1 | 3 |
| SEQ ID NO: 2294 | ttgactcaggaaggccaag | 12576 | 12595 | SEQ ID NO: 2600 | cttggtacgagttactcaa | 12632 | 12651 | 1 | 3 |
| SEQ ID NO: 2295 | gaaacctgggatatacact | 12728 | 12747 | SEQ ID NO: 2601 | agtgattacacttcctttc | 12857 | 12876 | 1 | 3 |
| SEQ ID NO: 2296 | tcctttcgagttaaggaaa | 12869 | 12888 | SEQ ID NO: 2602 | tttctgccactgctcagga | 13516 | 13535 | 1 | 3 |
| SEQ ID NO: 2297 | gccattcagtctctcaaga | 12966 | 12985 | SEQ ID NO: 2603 | tcttccgttctgtaatggc | 5794 | 5813 | 1 | 3 |
| SEQ ID NO: 2298 | gtgctacgtaatcttcagg | 12993 | 13012 | SEQ ID NO: 2604 | cctgcaccaaagctggcac | 13956 | 13975 | 1 | 3 |
| SEQ ID NO: 2299 | agctgaaagagatgaaatt | 13057 | 13076 | SEQ ID NO: 2605 | aatttattcaaaacgagct | 13192 | 13211 | 1 | 3 |

TABLE 8-continued

Selected palindromic sequences from human ApoB

| Source | Start Index | End Index | Match | Start Index | End Index | # | B |
|---|---|---|---|---|---|---|---|
| SEQ ID NO: 2300 aatttacttatcttattaa | 13072 | 13091 | SEQ ID NO: 2606 ttaaaagaaatcttcaatt | 13807 | 13826 | 1 | 3 |
| SEQ ID NO: 2301 ttttaaattgttgaaagaa | 13142 | 13161 | SEQ ID NO: 2607 ttctctctatgggaaaaaa | 9558 | 9577 | 1 | 3 |
| SEQ ID NO: 2302 taatcttcataagttcaat | 13172 | 13191 | SEQ ID NO: 2608 attgagattccctccatta | 11694 | 11713 | 1 | 3 |
| SEQ ID NO: 2303 atattttgatccaagtata | 13271 | 13290 | SEQ ID NO: 2609 tataagcagaagcacatat | 13929 | 13948 | 1 | 3 |
| SEQ ID NO: 2304 tgaaatattatgaacttga | 13303 | 13322 | SEQ ID NO: 2610 tcaaccttaatgattttca | 8287 | 8306 | 1 | 3 |
| SEQ ID NO: 2305 caatttctgcacagaaata | 13434 | 13453 | SEQ ID NO: 2611 tattcttcttttccaattg | 13826 | 13845 | 1 | 3 |
| SEQ ID NO: 2306 agaagattgcagagctttc | 13501 | 13520 | SEQ ID NO: 2612 gaaatcttcaatttattct | 13813 | 13832 | 1 | 3 |
| SEQ ID NO: 2307 gaagaaataatttctgat | 13562 | 13581 | SEQ ID NO: 2613 atcagttcagataaacttc | 7991 | 8010 | 1 | 3 |
| SEQ ID NO: 2308 ttgacctgtccattcaaaa | 13672 | 13691 | SEQ ID NO: 2614 ttttgagaatgaatttcaa | 10414 | 10433 | 1 | 3 |
| SEQ ID NO: 2309 tcaaaactaccacacattt | 13685 | 13704 | SEQ ID NO: 2615 aaattccttgacatgttga | 7362 | 7381 | 1 | 3 |
| SEQ ID NO: 2310 tttttaaaagaaatcttc | 13803 | 13822 | SEQ ID NO: 2616 gaagtgtcagtggcaaaaa | 10374 | 10393 | 1 | 3 |
| SEQ ID NO: 2311 aggatctgagttattttgc | 14035 | 14054 | SEQ ID NO: 2617 gcaagggttcactgttcct | 7856 | 7875 | 1 | 3 |
| SEQ ID NO: 2312 tttgctaaacttgggggag | 14049 | 14068 | SEQ ID NO: 2618 ctccccaggacctttcaaa | 9834 | 9853 | 1 | 3 |

# = Match Number
B = Middle Matching Bases

TABLE 9

Selected palindromic sequences from human ApoB

| Source | Start Index | End Index | Match | Index | Start Index | End # | B |
|---|---|---|---|---|---|---|---|
| SEQ ID NO: 2619 ggccattccagaagggaag | 517 | 536 | SEQ ID NO: 3948 cttccgttctgtaatggcc | 5803 | 5822 | 1 | 9 |
| SEQ ID NO: 2620 tgccatctcgagagttcca | 4107 | 4126 | SEQ ID NO: 3949 tggaactctctccatggca | 10884 | 10903 | 1 | 8 |
| SEQ ID NO: 2621 catgtcaaacactttgtta | 7064 | 7083 | SEQ ID NO: 3950 taacaaattccttgacatg | 7366 | 7385 | 1 | 8 |
| SEQ ID NO: 2622 tttgttataaatcttattg | 7076 | 7095 | SEQ ID NO: 3951 caataagatcaatagcaaa | 8998 | 9017 | 1 | 8 |
| SEQ ID NO: 2623 tctggaaaagggtcatgga | 8888 | 8907 | SEQ ID NO: 3959 tccatgtcccatttacaga | 11364 | 11383 | 1 | 8 |
| SEQ ID NO: 2624 cagctcttgttcaggtcca | 10908 | 10927 | SEQ ID NO: 3960 tggacctgcaccaaagctg | 13960 | 13979 | 1 | 8 |
| SEQ ID NO: 2625 ggaggttccccagctctgc | 364 | 383 | SEQ ID NO: 3061 gcagccctgggaaaactcc | 6455 | 6474 | 1 | 7 |
| SEQ ID NO: 2626 ctgttttgaagactctcca | 1089 | 1108 | SEQ ID NO: 3962 tggagggtagtcataacag | 10335 | 10354 | 1 | 7 |
| SEQ ID NO: 2627 agtggctgaaacgtgtgca | 1305 | 1324 | SEQ ID NO: 3963 tgcagagctttctgccact | 13516 | 13535 | 1 | 7 |
| SEQ ID NO: 2628 ccaaaatagaagggaatct | 2076 | 2095 | SEQ ID NO: 3964 agattcctttgccttttgg | 4008 | 4027 | 1 | 7 |
| SEQ ID NO: 2629 tgaagagaagattgaattt | 3628 | 3647 | SEQ ID NO: 3965 aaattctcttttcttttca | 9220 | 9239 | 1 | 7 |
| SEQ ID NO: 2630 agtggtggcaacaccagca | 4238 | 4257 | SEQ ID NO: 3966 tgctagtgaggccaacact | 10657 | 10676 | 1 | 7 |
| SEQ ID NO: 2631 aaggctccacaagtcatca | 5958 | 5977 | SEQ ID NO: 3967 tgatgatatctggaaccTT | 10732 | 10751 | 1 | 7 |
| SEQ ID NO: 2632 gtcagccaggtttatagca | 7733 | 7752 | SEQ ID NO: 3968 tgctaagaaccttactgac | 7789 | 7808 | 1 | 7 |
| SEQ ID NO: 2633 tgatatctggaaccttgaa | 10735 | 10754 | SEQ ID NO: 3969 ttcactgttcctgaaatca | 7871 | 7890 | 1 | 7 |
| SEQ ID NO: 2634 gtcaagttgagcaatttct | 13431 | 13450 | SEQ ID NO: 3970 agaaaaggcacaccttgac | 11080 | 11099 | 1 | 7 |
| SEQ ID NO: 2635 atccagatggaaaagggaa | 13488 | 13507 | SEQ ID NO: 3971 ttccaatttccctgtggat | 3688 | 3707 | 1 | 7 |
| SEQ ID NO: 2636 atttgtttgtcaaagaagt | 4551 | 4570 | SEQ ID NO: 3972 acttcagagaaatacaaat | 11409 | 11428 | 4 | 6 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 2637 ctggaaaatgtcagcctgg | 212 | 231 | SEQ ID NO: 3973 ccagacttccgtttcccag | | 8243 | 8262 | 2 | 6 |
| SEQ ID NO: 2638 accaggaggttcttcttca | 1737 | 1756 | SEQ ID NO: S974 tgaagtgtagtctcctggt | | 5097 | 5116 | 2 | 6 |
| SEQ ID NO: 2639 aaagaagttctgaaagaat | 1964 | 1983 | SEQ ID NO: 3975 attccatcacaaatccttt | | 9669 | 9688 | 2 | 6 |
| SEQ ID NO: 2640 gctacagcttatggctcca | 3578 | 3597 | SEQ ID NO: 3976 tggatctaaatgcagtagc | | 11631 | 11650 | 2 | 6 |
| SEQ ID NO: 2641 atcaatattgatcaatttg | 6422 | 6441 | SEQ ID NO: 3977 caaagaagtcaagattgat | | 4561 | 4580 | 2 | 6 |
| SEQ ID NO: 2642 gaattatcttttaaaacat | 7334 | 7353 | SEQ ID NO: 3978 atgtgttaacaaaatattc | | 11502 | 11521 | 2 | 6 |
| SEQ ID NO: 2643 cgaggcccgcgctgctggc | 138 | 157 | SEQ ID NO: 3979 gccagaagtgagatcctcg | | 3515 | 3534 | 1 | 6 |
| SEQ ID NO: 2644 acaactatgaggctgagag | 279 | 298 | SEQ ID NO: 3980 ctctgagcaacaaatttgt | | 10317 | 10336 | 1 | 6 |
| SEQ ID NO: 2645 gctgagagttccagtggag | 290 | 309 | SEQ ID NO: 3981 ctccatggcaaatgtcagc | | 10893 | 10912 | 1 | 6 |
| SEQ ID NO: 2646 tgaagaaaaccaagaactc | 456 | 475 | SEQ ID NO: 3982 gagtcattgaggttcttca | | 4937 | 4956 | 1 | 6 |
| SEQ ID NO: 2647 cctacttacatcctgacca | 566 | 585 | SEQ ID NO: 3983 tgttcataagggaggtagg | | 12774 | 12793 | 1 | 6 |
| SEQ ID NO: 2648 ctacttacatcctgaacat | 567 | 586 | SEQ ID NO: 3984 atgttcataagggaggtag | | 12773 | 12792 | 1 | 6 |
| SEQ ID NO: 2649 gagacagaagaagccaagc | 623 | 642 | SEQ ID NO: 3985 gcttggttttgccagtctc | | 2467 | 2486 | 1 | 6 |
| SEQ ID NO: 2650 cactcactttaccgtcaag | 679 | 698 | SEQ ID NO: 3986 cttgaacacaaagtcagtg | | 6008 | 6027 | 1 | 6 |
| SEQ ID NO: 2651 ctgatcagcagcagccagt | 830 | 849 | SEQ ID NO: 3987 actgggaagtgcttatcag | | 5245 | 5264 | 1 | 6 |
| SEQ ID NO: 2652 actggacgctaagaggccg | 862 | 881 | SEQ ID NO: 3988 cttcccccaagcgcccagt | | 2898 | 2917 | 1 | 6 |
| SEQ ID NO: 2653 agaggaagcatgtggcaga | 873 | 892 | SEQ ID NO: 3989 tctggcatttactttctct | | 5929 | 5948 | 1 | 8 |
| SEQ ID NO: 2654 tgaagactctccaggaact | 1095 | 1114 | SEQ ID NO: 3990 agttgaaggagactattca | | 7224 | 7243 | 1 | 6 |
| SEQ ID NO: 2655 ctctgagcaaaatatccag | 1129 | 1148 | SEQ ID NO: 3991 ctggttactgagctgagag | | 1169 | 1188 | 1 | 6 |
| SEQ ID NO: 2656 atgaagcagtcacatctct | 1197 | 1216 | SEQ ID NO: 3992 agagctgccagtccttcat | | 10024 | 10043 | 1 | 6 |
| SEQ ID NO: 2657 ttgccacagctgattgagg | 1217 | 1236 | SEQ ID NO: 3993 cctcctacagtggtgcaa | | 4230 | 4249 | 1 | 6 |
| SEQ ID NO: 2658 agctgattgaggtgtccag | 1224 | 1243 | SEQ ID NO: 3994 ctggattccacatgcagct | | 11855 | 11874 | 1 | 6 |
| SEQ ID NO: 2659 tgctccactcacatcctcc | 1286 | 1305 | SEQ ID NO: 3995 ggaggctttaagttcagca | | 7609 | 7628 | 1 | 6 |
| SEQ ID NO: 2660 tgacacgtgtgcatgccaa | 1311 | 1330 | SEQ ID NO: 3996 ttgggagagacaagtttca | | 6508 | 6527 | 1 | 6 |
| SEQ ID NO: 2661 gacattgctaattacctga | 1511 | 1530 | SEQ ID NO: 3997 tcagaagctaagcaatgtc | | 7240 | 7259 | 1 | 6 |
| SEQ ID NO: 2662 ttcttcttcagacttttcct | 1746 | 1765 | SEQ ID NO: 3998 aggagagtccaaattagaa | | 8506 | 8525 | 1 | 6 |
| SEQ ID NO: 2663 ccaatatcttgaactcaga | 1911 | 1930 | SEQ ID NO: 3999 tctgaattcattcaattgg | | 6493 | 6512 | 1 | 6 |
| SEQ ID NO: 2684 aaagttagtgaaagaagtt | 1954 | 1973 | SEQ ID NO: 4000 aactaccctcactgcctttt | | 2140 | 2159 | 1 | 6 |
| SEQ ID NO: 2665 aagttagtgaaagaagttc | 1955 | 1974 | SEQ ID NO: 4001 gaacctctggcatttactt | | 5924 | 5943 | 1 | 6 |
| SEQ ID NO: 2666 aaagaagttctgcacgaat | 1964 | 1983 | SEQ ID NO: 4002 attctctggtaactactttt | | 5490 | 5509 | 1 | 6 |
| SEQ ID NO: 2667 tttggctataccaaagatg | 2330 | 2349 | SEQ ID NO: 4003 catcttaggcactgacaaa | | 5005 | 5024 | 1 | 6 |
| SEQ ID NO: 2668 tgttgagaagctgattaaa | 2389 | 2408 | SEQ ID NO: 4004 tttagccatcggctcaaca | | 5708 | 5727 | 1 | 6 |
| SEQ ID NO: 2669 caggaagggctcaaagaat | 2569 | 2588 | SEQ ID NO: 4005 attcctttaacaattcctg | | 9500 | 9519 | 1 | 6 |
| SEQ ID NO: 2670 aggaagggctcaaagaatg | 2570 | 2589 | SEQ ID NO: 4006 cattcctttaacaattcct | | 9499 | 9518 | 1 | 6 |
| SEQ ID NO: 2671 gaagggctcaaagaatgac | 2572 | 2591 | SEQ ID NO: 4007 gtcagtcttcaggctcttc | | 7922 | 7941 | 1 | 6 |
| SEQ ID NO: 2672 caaagaatgacttttttct | 2580 | 2599 | SEQ ID NO: 4008 agaaggatggcatttttg | | 14008 | 14027 | 1 | 6 |
| SEQ ID NO: 2673 catggagaatgcctttgaa | 2611 | 2630 | SEQ ID NO: 4009 ttcagagccaaagtccatg | | 7127 | 7146 | 1 | 6 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 2674 ggagccaaggctggagtaa | 2687 | 2706 | SEQ ID NO: 4010 ttactccaacgccagctcc | 3058 | 3077 | 1 | | 6 |
| SEQ ID NO: 2675 tcattccttccccaaagag | 2892 | 2911 | SEQ ID NO: 4011 ctctctggggcatctatga | 5147 | 5166 | 1 | | 6 |
| SEQ ID NO: 2676 acctatgagctccagagag | 3173 | 3192 | SEQ ID NO: 4012 ctctcaagaccacagaggt | 12984 | 13003 | 1 | | 6 |
| SEQ ID NO: 2677 gggcaaaacgtcttacaga | 3373 | 3392 | SEQ ID NO: 4013 tctgaaagacaacgtgccc | 12325 | 12344 | 1 | | 6 |
| SEQ ID NO: 2678 accctggacattcagaaca | 3395 | 3414 | SEQ ID NO: 4014 tcttgctaaggttcagggt | 5683 | 5702 | 1 | | 6 |
| SEQ ID NO: 2679 atgggcgacctaagttgtg | 3437 | 3456 | SEQ ID NO: 4015 cacaaattagtttcaccat | 8949 | 8968 | 1 | | 6 |
| SEQ ID NO: 2680 gatgaagagaagattgaat | 3626 | 3645 | SEQ ID NO: 4016 attccagcttccccacatc | 8338 | 8357 | 1 | | 6 |
| SEQ ID NO: 2681 caatgtagataccaaaaaa | 3664 | 3683 | SEQ ID NO: 4017 ttttttggaaatgccattg | 8651 | 8670 | 1 | | 6 |
| SEQ ID NO: 2682 gtagataccaaaaaaatga | 3668 | 3687 | SEQ ID NO: 4018 tcatgtgatgggtctctac | 4379 | 4398 | 1 | | 6 |
| SEQ ID NO: 2683 gcttcagttcatttggact | 4517 | 4536 | SEQ ID NO: 4019 agtcaagaaggacttaagc | 5312 | 5331 | 1 | | 6 |
| SEQ ID NO: 2684 tttgtttgtcaaagaagtc | 4552 | 4571 | SEQ ID NO: 4020 gacttcagagaaatacaaa | 11408 | 11427 | 1 | | 6 |
| SEQ ID NO: 2685 ttgtttgtcaaagaagtca | 4553 | 4572 | SEQ ID NO: 4021 tgacttcagagaaatacaa | 11407 | 11426 | 1 | | 6 |
| SEQ ID NO: 2686 tggcaatgggaaactcgct | 5854 | 5873 | SEQ ID NO: 4022 agcgagaatcaccctgcca | 8227 | 8246 | 1 | | 6 |
| SEQ ID NO: 2687 aacctctggcatttacttt | 5925 | 5944 | SEQ ID NO: 4023 aaaggagatgtcaagggtt | 10607 | 10626 | 1 | | 6 |
| SEQ ID NO: 2688 catttactttctctcatga | 5934 | 5953 | SEQ ID NO: 4024 tcatttgaaagaataaatg | 7034 | 7053 | 1 | | 6 |
| SEQ ID NO: 2689 aaagtcagtgccctgctta | 6017 | 6036 | SEQ ID NO: 4025 taagaaccttactgactttt | 7792 | 7811 | 1 | | 6 |
| SEQ ID NO: 2690 tcccattttttgagacctt | 6330 | 6349 | SEQ ID NO: 4026 aaggacttcaggaatggga | 12012 | 12031 | 1 | | 6 |
| SEQ ID NO: 2691 catcaatattgatcaattt | 6421 | 6440 | SEQ ID NO: 4027 aaattaaaaagtcttgatg | 6740 | 6759 | 1 | | 6 |
| SEQ ID NO: 2692 taaagatagttatgattta | 6673 | 6692 | SEQ ID NO: 4028 taaaccaaaacttggttta | 9027 | 9046 | 1 | | 6 |
| SEQ ID NO: 2693 tattgatgaaatcattgaa | 6721 | 6740 | SEQ ID NO: 4029 ttcaaagacttaaaacata | 8015 | 8034 | 1 | | 6 |
| SEQ ID NO: 2694 atgatctacatttgtttat | 6798 | 6817 | SEQ ID NO: 4030 cataaagaaattaaagtcat | 7388 | 7407 | 1 | | 6 |
| SEQ ID NO: 2695 agagacacatacagaatat | 6927 | 6946 | SEQ ID NO: 4031 atatattgtcagtgcctct | 13390 | 13409 | 1 | | 6 |
| SEQ ID NO: 2696 gacacatacagaatataga | 6930 | 6949 | SEQ ID NO: 4032 tctaaattcagttcttgtc | 11335 | 11354 | 1 | | 6 |
| SEQ ID NO: 2697 agcatgtcaaacactttgt | 7062 | 7081 | SEQ ID NO: 4033 acaaagtcagtgccctgct | 6015 | 6034 | 1 | | 6 |
| SEQ ID NO: 2698 tttttagaggaaaccaagg | 7523 | 7542 | SEQ ID NO: 4034 cctttgtgtacaccaaaaa | 11238 | 11257 | 1 | | 6 |
| SEQ ID NO: 2699 ttttagaggaaaccaaggc | 7524 | 7543 | SEQ ID NO: 4035 gcctttgtgtacaccaaaa | 11237 | 11256 | 1 | | 6 |
| SEQ ID NO: 2700 ggaagatagacttcctgaa | 9315 | 9334 | SEQ ID NO: 4036 ttcagaaatactgttttcc | 12832 | 12851 | 1 | | 8 |
| SEQ ID NO: 2701 cactgtttctgagtcccag | 9342 | 9361 | SEQ ID NO: 4037 ctgggacctaccaagagtg | 12531 | 12550 | 1 | | 6 |
| SEQ ID NO: 2702 cacaaatcctttggctgtg | 9676 | 9695 | SEQ ID NO: 4038 cacatttcaaggaattgtg | 10071 | 10090 | 1 | | 6 |
| SEQ ID NO: 2703 ttcctggatacactgttcc | 9861 | 9880 | SEQ ID NO: 4039 ggaactgttgactcaggaa | 12577 | 12596 | 1 | | 6 |
| SEQ ID NO: 2704 gaaatctcaagctttctct | 10050 | 10069 | SEQ ID NO: 4040 agagccaggtcgagctttc | 11052 | 11071 | 1 | | 6 |
| SEQ ID NO: 2705 tttcttcatcttcatctgt | 10218 | 10237 | SEQ ID NO: 4041 acagctgaaagagatgaaa | 13063 | 13082 | 1 | | 6 |
| SEQ ID NO: 2706 tctaccgctaaaggagcag | 10529 | 10548 | SEQ ID NO: 4042 ctgcacgctttgaggtaga | 11769 | 11788 | 1 | | 6 |
| SEQ ID NO: 2707 ctaccgctaaaggagcagt | 10530 | 10549 | SEQ ID NO: 4043 actgcacgctttgaggtag | 11768 | 11787 | 1 | | 6 |
| SEQ ID NO: 2708 agggcctctttttcaccaa | 10839 | 10858 | SEQ ID NO: 4044 ttggccaggaagtggccct | 10965 | 10984 | 1 | | 6 |
| SEQ ID NO: 2709 ttctccatccctgtaaaag | 11273 | 11292 | SEQ ID NO: 4045 cttttcaccaacggagaa | 10846 | 10865 | 1 | | 6 |
| SEQ ID NO: 2710 gaaaaacaaagcagattat | 11824 | 11843 | SEQ ID NO: 4046 ataaactgcaagatttttc | 13608 | 13627 | 1 | | 6 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 2711 actcactcattgattttct | 12690 | 12709 | SEQ ID NO: | 4047 agaaaatcaggatctgagt | 14035 | 14054 | 1 | 6 |
| SEQ ID NO: 2712 taaactaatagatgtaatc | 12898 | 12917 | SEQ ID NO: | 4048 gattaccaccagcagttta | 13586 | 13605 | 1 | 8 |
| SEQ ID NO: 2713 caaaacgagcttcaggaag | 13208 | 13227 | SEQ ID NO: | 4049 cttcgtgaagaatatttg | 13268 | 13287 | 1 | 6 |
| SEQ ID NO: 2714 tggaataatgctcagtgtt | 2374 | 2393 | SEQ ID NO: | 4050 aacacttacttgaattcca | 10670 | 10689 | 3 | 5 |
| SEQ ID NO: 2715 gatttgaaatccaaagaag | 2408 | 2427 | SEQ ID NO: | 4051 cttcagagaaatacaaatc | 11410 | 11429 | 3 | 5 |
| SEQ ID NO: 2716 atttgaaatccaaagaagt | 2409 | 2428 | SEQ ID NO: | 4052 acttcagagaaatacaaat | 11409 | 11428 | 3 | 5 |
| SEQ ID NO: 2717 atcaacagccgcttctttg | 998 | 1017 | SEQ ID NO: | 4053 caaagaagtcaagattgat | 4561 | 4580 | 2 | 5 |
| SEQ ID NO: 2718 tgttttgaagactctccag | 1090 | 1109 | SEQ ID NO: | 4054 ctggaaagttaaaacaaca | 6963 | 6982 | 2 | 5 |
| SEQ ID NO: 2719 cccttctgatagatgtggt | 1332 | 1351 | SEQ ID NO: | 4055 accaaagctggcaccaggg | 13969 | 13988 | 2 | a |
| SEQ ID NO: 2720 tgagcaagtgaagaacttt | 1876 | 1895 | SEQ ID NO: | 4056 aaagccattcagtctctca | 12971 | 12990 | 2 | 5 |
| SEQ ID NO: 2721 atttgaaatccaaagaagt | 2409 | 2428 | SEQ ID NO: | 4057 acttttctaaacttgaaat | 9063 | 9082 | 2 | 5 |
| SEQ ID NO: 2722 atccaaagaagtcccggaa | 2416 | 2435 | SEQ ID NO: | 4058 ttccggggaaacctgggat | 12729 | 12748 | 2 | 5 |
| SEQ ID NO: 2723 agagcctacctccgcatct | 2438 | 2457 | SEQ ID NO: | 4059 agatggtacgttagcctct | 11929 | 11948 | 2 | 5 |
| SEQ ID NO: 2724 aatgcctttgaactccca | 2618 | 2637 | SEQ ID NO: | 4060 tgggaactacaatttcatt | 7020 | 7039 | 2 | 5 |
| SEQ ID NO: 2725 gaagtccaaattccggatt | 3305 | 3324 | SEQ ID NO: | 4061 aatcttccatttattcttc | 13823 | 13842 | 2 | 5 |
| SEQ ID NO: 2726 tgcaagcagaagccagaag | 3504 | 3523 | SEQ ID NO: | 4062 cttcaggttccatcgtgca | 11384 | 11403 | 2 | 5 |
| SEQ ID NO: 2727 gaagagaagattgaatttg | 3629 | 3648 | SEQ ID NO: | 4063 caaaacctactgtctcttc | 10467 | 10486 | 2 | 5 |
| SEQ ID NO: 2728 atgctaaaggcacatatgg | 4605 | 4624 | SEQ ID NO: | 4064 ccatatgaaagtcaagcat | 12664 | 12683 | 2 | 5 |
| SEQ ID NO: 2729 tccctcacctccacctctg | 4745 | 4764 | SEQ ID NO: | 4065 cagattctcagatgaggga | 8920 | 8939 | 2 | 5 |
| SEQ ID NO: 2730 atttacagctctgacaagt | 5435 | 5454 | SEQ ID NO: | 4066 acttttctaaacttgaaat | 9063 | 9082 | 2 | 5 |
| SEQ ID NO: 2731 aggagcctaccaaaataat | 5602 | 5621 | SEQ ID NO: | 4067 attatgttgaaacagtcct | 11838 | 11857 | 2 | 5 |
| SEQ ID NO: 2732 aaagctgaagcacatcaat | 6409 | 6428 | SEQ ID NO: | 4068 attgttgctcatctccttt | 10202 | 10221 | 2 | 5 |
| SEQ ID NO: 2733 ctgctggaaacaacgagaa | 9426 | 9445 | SEQ ID NO: | 4069 ttctgattaccaccagcag | 13582 | 13601 | 2 | 5 |
| SEQ ID NO: 2734 ttgaaggaattcttgaaaa | 9590 | 9609 | SEQ ID NO: | 4070 ttttaaaagaaatcttcaa | 13813 | 13832 | 2 | 5 |
| SEQ ID NO: 2735 gaagtaaaagaaaattttg | 10751 | 10770 | SEQ ID NO: | 4071 caaaacctactgtctcttc | 10467 | 10486 | 2 | 5 |
| SEQ ID NO: 2736 tgaagaagatgtgcaaattt | 11992 | 12011 | SEQ ID NO: | 4072 aaatgtcagctcttgttca | 10902 | 10921 | 2 | 5 |
| SEQ ID NO: 2737 aggatctgagttattttgc | 14043 | 14082 | SEQ ID NO: | 4073 gcaagtcagcccagttcct | 10928 | 10947 | 2 | 5 |
| SEQ ID NO: 2738 gtgcccttctcggttgct | 26 | 45 | SEQ ID NO: | 4074 cagccattgacatgagcac | 5748 | 5767 | 1 | 5 |
| SEQ ID NO: 2739 ggcgctgcctgcgctgctg | 154 | 173 | SEQ ID NO: | 4075 cagctccacagactccgcc | 3070 | 3089 | 1 | 5 |
| SEQ ID NO: 2740 ctgcgctgctgctgctgct | 162 | 181 | SEQ ID NO: | 4076 agcagaaggtgcgaagcag | 3232 | 3251 | 1 | 5 |
| SEQ ID NO: 2741 gctgctggcgggcgccagg | 178 | 197 | SEQ ID NO: | 4077 cctggattccacatgcagc | 11854 | 11873 | 1 | 5 |
| SEQ ID NO: 2742 aagaggaaatgctggaaaa | 201 | 220 | SEQ ID NO: | 4078 ttttctcttcactacatctt | 2592 | 2611 | 1 | 5 |
| SEQ ID NO: 2743 ctggaaaatgtcagcctgg | 212 | 231 | SEQ ID NO: | 4079 ccagacttccacatcccag | 3923 | 3942 | 1 | 5 |
| SEQ ID NO: 2744 tggagtccctgggactgct | 304 | 323 | SEQ ID NO: | 4080 agcatgcctagtttctcca | 9953 | 9972 | 1 | 5 |
| SEQ ID NO: 2745 ggagtccctgggactgctg | 305 | 324 | SEQ ID NO: | 4081 cagcatgcctagtttctcc | 9952 | 9971 | 1 | 5 |
| SEQ ID NO: 2746 tgggactgctgattcaaga | 313 | 332 | SEQ ID NO: | 4082 tcttccatcacttgaccca | 2050 | 2069 | 1 | 5 |
| SEQ ID NO: 2747 ctgctgattcaagaagtgc | 318 | 337 | SEQ ID NO: | 4083 gcacaccttgacattgcag | 11087 | 11106 | 1 | 5 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 2748 tgccaccaggatcaactgc | 334 | 353 | SEQ ID NO: | 4084 gcaggctgaactggtggca | 2725 | 2744 | 1 | 5 |
| SEQ ID NO: 2749 gccaccaggatcaactgca | 335 | 354 | SEQ ID NO: | 4085 tgcaggctgaactggtggc | 2724 | 2743 | 1 | 5 |
| SEQ ID NO: 2750 tgcaaggttgagctggagg | 350 | 369 | SEQ ID NO: | 4086 cctccacctctgatctgca | 4752 | 4771 | 1 | 5 |
| SEQ ID NO: 2751 caaggttgagctggaggtt | 352 | 371 | SEQ ID NO: | 4089 aaccctacatgaagcttg | 13763 | 13782 | 1 | 5 |
| SEQ ID NO: 2752 ctctgcagcttcatcctga | 377 | 396 | SEQ ID NO: | 4090 tcaggaagcttctcaagag | 13219 | 13238 | 1 | 5 |
| SEQ ID NO: 2753 cagcttcatcctgaagacc | 382 | 401 | SEQ ID NO: | 4091 ggtcttgagttaaatgctg | 4985 | 5004 | 1 | 5 |
| SEQ ID NO: 2754 gcttcatcctgaagaccag | 384 | 403 | SEQ ID NO: | 4092 ctggacgctaagaggaagc | 863 | 882 | 1 | 5 |
| SEQ ID NO: 2755 tcatcctgaagaccagcca | 387 | 406 | SEQ ID NO: | 4093 tggcatggcattatgatga | 3612 | 3631 | 1 | 5 |
| SEQ ID NO: 2756 gaaaaccaagaactctgag | 460 | 479 | SEQ ID NO: | 4094 ctcaaccttaatgattttc | 8294 | 8313 | 1 | 5 |
| SEQ ID NO: 2757 agaactctgaggagtttgc | 468 | 487 | SEQ ID NO: | 4095 gcaagctatacagtattct | 8385 | 8404 | 1 | 5 |
| SEQ ID NO: 2758 tctgaggagtttgctgcag | 473 | 492 | SEQ ID NO: | 4096 ctgcaggggatcccccaga | 2534 | 2553 | 1 | 5 |
| SEQ ID NO: 2759 tttgctgcagccatgtcca | 482 | 501 | SEQ ID NO: | 4097 tggaagtgtcagtggccaa | 10380 | 10399 | 1 | 5 |
| SEQ ID NO: 2760 caagaggggcatcatttct | 586 | 605 | SEQ ID NO: | 4098 agaataaatgacgttcttg | 7043 | 7062 | 1 | 5 |
| SEQ ID NO: 2761 tcactttaccgtcaagacg | 682 | 701 | SEQ ID NO: | 4099 cgtctacactatcatgtga | 4368 | 4387 | 1 | 5 |
| SEQ ID NO: 2762 tttaccgtcaagacgagga | 686 | 705 | SEQ ID NO: | 4100 tccttgacatgttgataaa | 7374 | 7393 | 1 | 5 |
| SEQ ID NO: 2763 cactggacgctaagaggaa | 861 | 880 | SEQ ID NO: | 4101 ttccagaaagcagccagtg | 12506 | 12525 | 1 | 6 |
| SEQ ID NO: 2764 aggaagcatgtggcagaag | 875 | 894 | SEQ ID NO: | 4102 cttcatacacattaatcct | 9996 | 10015 | 1 | 5 |
| SEQ ID NO: 2765 caaggagcaacacctcttc | 901 | 920 | SEQ ID NO: | 4103 gaagtagtactgcatcttg | 6843 | 6862 | 1 | 5 |
| SEQ ID NO: 2766 acagactttgaaacttgaa | 967 | 986 | SEQ ID NO: | 4104 ttcaattcttcaatgctgt | 10508 | 10527 | 1 | 5 |
| SEQ ID NO: 2767 tgatgaagcagtcacatct | 1195 | 1214 | SEQ ID NO: | 4105 agatttgaggattccatca | 7984 | 8003 | 1 | 5 |
| SEQ ID NO: 2768 agcagtcacatctctcttg | 1201 | 1220 | SEQ ID NO: | 4106 caaggagaaactgactgct | 6532 | 6551 | 1 | 5 |
| SEQ ID NO: 2769 ccagccccatcactttaca | 1239 | 1258 | SEQ ID NO: | 4107 tgtagtctcctggtgctgg | 5102 | 5121 | 1 | 5 |
| SEQ ID NO: 2770 ctccactcacatcctccag | 1288 | 1307 | SEQ ID NO: | 4108 ctggagcttagtaatggag | 8717 | 8736 | 1 | 5 |
| SEQ ID NO: 2771 catgccaaacccttctga | 1322 | 1341 | SEQ ID NO: | 4109 tcagatgagggaacacatg | 8927 | 8946 | 1 | 5 |
| SEQ ID NO: 2772 gagagatcttcaacatggc | 1398 | 1417 | SEQ ID NO: | 4110 gccaccctggaactctctc | 10877 | 10896 | 1 | 5 |
| SEQ ID NO: 2773 tcaacatggcgagggatca | 1407 | 1426 | SEQ ID NO: | 4111 tgatcccacctctcattga | 2973 | 2992 | 1 | 5 |
| SEQ ID NO: 2774 ccaccttgtatgcgctgag | 1437 | 1456 | SEQ ID NO: | 4112 ctcagggatctgaaggtgg | 8195 | 8214 | 1 | 5 |
| SEQ ID NO: 2775 gtcaacaactatcataaga | 1463 | 1482 | SEQ ID NO: | 4113 tcttgagttaaatgctgac | 4987 | 5006 | 1 | 5 |
| SEQ ID NO: 2776 tggacattgctaattacct | 1509 | 1528 | SEQ ID NO: | 4114 aggtatattcgaaagtcca | 12807 | 12826 | 1 | 5 |
| SEQ ID NO: 2777 ggacattgctaattacctg | 1510 | 1529 | SEQ ID NO: | 4115 caggtatattcgaaagtcc | 12806 | 12825 | 1 | 5 |
| SEQ ID NO: 2778 ttctgcgggtcattggaaa | 1581 | 1600 | SEQ ID NO: | 4116 tttcacatgccaaggagaa | 6522 | 6541 | 1 | 5 |
| SEQ ID NO: 2779 ccagaactcaagtcttcaa | 1628 | 1647 | SEQ ID NO: | 4117 ttgaagtgtagtctcctgg | 5096 | 5115 | 1 | 5 |
| SEQ ID NO: 2780 agtcttcaatcctgaaatg | 1638 | 1657 | SEQ ID NO: | 4118 catttctgattggtggact | 7765 | 7784 | 1 | 5 |
| SEQ ID NO: 2781 tgagcaagtgaagaacttt | 1876 | 1895 | SEQ ID NO: | 4119 aaagtgccactttactca | 6191 | 6210 | 1 | 5 |
| SEQ ID NO: 2782 agcaagtgaagaacttgt | 1878 | 1897 | SEQ ID NO: | 4120 acaaagtcagtgccctgct | 6015 | 6034 | 1 | 5 |
| SEQ ID NO: 2783 tctgaaagaatctcaactt | 1972 | 1991 | SEQ ID NO: | 4121 aagtccataatggttcaga | 12819 | 12838 | 1 | 5 |
| SEQ ID NO: 2784 actgtcatggacttcagaa | 1994 | 2013 | SEQ ID NO: | 4122 ttctgaatatattgtcagt | 13384 | 13403 | 1 | 5 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 2785 acttgacccagcctcagcc | 2059 | 2078 | SEQ ID NO: | 4123 ggctcaccctgagagaagt | 12399 | 12418 | 1 | 5 |
| SEQ ID NO: 2786 tccaaataactaccttcct | 2104 | 2123 | SEQ ID NO: | 4124 aggaagatatgaagatgga | 4720 | 4739 | 1 | 5 |
| SEQ ID NO: 2787 actaccctcactgcctttg | 2141 | 2160 | SEQ ID NO: | 4125 caaatttgtggagggtagt | 10327 | 10346 | 1 | 5 |
| SEQ ID NO: 2788 ttggatttgcttcagctga | 2157 | 2176 | SEQ ID NO: | 4126 tcagtataagtacaaccaa | 9400 | 9419 | 1 | 5 |
| SEQ ID NO: 2789 ttggaagctcttttggga | 2219 | 2238 | SEQ ID NO: | 4127 tcccgattcacgcttccaa | 11585 | 11604 | 1 | 5 |
| SEQ ID NO: 2790 ggaagctctttttgggaug | 2221 | 2240 | SEQ ID NO: | 4128 cttcagaaagctaccttcc | 7937 | 7956 | 1 | 5 |
| SEQ ID NO: 2791 tttttcccagacagtgtca | 2246 | 2265 | SEQ ID NO: | 4129 tgaccttctctaagcaaaa | 4884 | 4903 | 1 | 5 |
| SEQ ID NO: 2792 agacagtgtcaacaaagct | 2254 | 2273 | SEQ ID NO: | 4130 agcttggttttgccagtct | 2466 | 2485 | 1 | 5 |
| SEQ ID NO: 2793 ctttggctataccaaagat | 2329 | 2348 | SEQ ID NO: | 4131 atctcgtgtctaggaacag | 5976 | 5995 | 1 | 5 |
| SEQ ID NO: 2794 caaagatgataaacatgag | 2341 | 2360 | SEQ ID NO: | 4132 ctcaaggataacgtgtttg | 12617 | 12636 | 1 | 5 |
| SEQ ID NO: 2795 gatatggtaaatggaataa | 2363 | 2382 | SEQ ID NO: | 4133 ttatcttattaattatatc | 13087 | 13106 | 1 | 5 |
| SEQ ID NO: 2796 ggaataatgctcagtgttg | 2375 | 2394 | SEQ ID NO: | 4134 caacacttacttgaattcc | 10669 | 10688 | 1 | 5 |
| SEQ ID NO: 2797 tttgaaatccaaagaagtc | 2410 | 2429 | SEQ ID NO: | 4135 gacttcagagaaatacaaa | 11408 | 11427 | 1 | 5 |
| SEQ ID NO: 2798 gatcccccagatgattgga | 2542 | 2561 | SEQ ID NO: | 4136 tccaatttccctgtggatc | 3689 | 3708 | 1 | 5 |
| SEQ ID NO: 2799 cagatgattggagaggtca | 2549 | 2568 | SEQ ID NO: | 4137 tgaccacacaaacagtctg | 5371 | 5390 | 1 | 5 |
| SEQ ID NO: 2800 agaatgactttttcttca | 2583 | 2602 | SEQ ID NO: | 4138 tgaagtccggattcattct | 11023 | 11042 | 1 | 5 |
| SEQ ID NO: 2801 gaactccccactggagctg | 2627 | 2646 | SEQ ID NO: | 4139 cagctcaaccgtacagttc | 11869 | 11888 | 1 | 5 |
| SEQ ID NO: 2802 atatcttcatctggagtca | 2660 | 2679 | SEQ ID NO: | 4140 tgacttcagtgcagaatat | 11974 | 11993 | 1 | 5 |
| SEQ ID NO: 2803 gtcattgctcccggagcca | 2675 | 2694 | SEQ ID NO: | 4141 tggccccgtttaccatgac | 5817 | 5836 | 1 | 5 |
| SEQ ID NO: 2804 gctgaagtttatcattcct | 2881 | 2900 | SEQ ID NO: | 4142 aggaggctttaagttcagc | 7608 | 7627 | 1 | 5 |
| SEQ ID NO: 2805 attccttccccaaagagac | 2894 | 2913 | SEQ ID NO: | 4143 gtctcttcctccatggaat | 10478 | 10497 | 1 | 5 |
| SEQ ID NO: 2806 ctcattgagaacaggcagt | 2984 | 3003 | SEQ ID NO: | 4144 actgactgcacgctttgag | 11764 | 11783 | 1 | 5 |
| SEQ ID NO: 2807 ttgagcagtattctgtcag | 3150 | 3169 | SEQ ID NO: | 4145 ctgagagaagtgtcttcaa | 12407 | 12428 | 1 | 5 |
| SEQ ID NO: 2808 accttgtccagtgaagtcc | 3293 | 3312 | SEQ ID NO: | 4146 ggacgtactgtcccaggt | 12792 | 12811 | 1 | 5 |
| SEQ ID NO: 2809 ccagtgaagtccaaattcc | 3300 | 3319 | SEQ ID NO: | 4147 ggaaggcagagtttactgg | 9156 | 9175 | 1 | 5 |
| SEQ ID NO: 2810 acattcagaacaagaaaat | 3402 | 3421 | SEQ ID NO: | 4148 atttcctaaagctggatgt | 11175 | 11194 | 1 | 5 |
| SEQ ID NO: 2811 gaaaaatcaagggtgttat | 3471 | 3490 | SEQ ID NO: | 4149 ataaactgcaagattttc | 13608 | 13627 | 1 | 5 |
| SEQ ID NO: 2812 aaatcaagggtgttatttc | 3474 | 3493 | SEQ ID NO: | 4150 gaaacaatgcattagattt | 9753 | 9772 | 1 | 5 |
| SEQ ID NO: 2813 tggcattatgatgaagaga | 3617 | 3636 | SEQ ID NO: | 4151 tctcccgtgtataatgcca | 11789 | 11808 | 1 | 5 |
| SEQ ID NO: 2814 aagagaagattgaatttga | 3630 | 3649 | SEQ ID NO: | 4152 tcaaaacctactgtctctt | 10466 | 10485 | 1 | 5 |
| SEQ ID NO: 2815 aaatgacttccaatttccc | 3681 | 3700 | SEQ ID NO: | 4153 gggaactacaatttcattt | 7021 | 7040 | 1 | 5 |
| SEQ ID NO: 2816 atgacttccaatttccctg | 3683 | 3702 | SEQ ID NO: | 4154 caggctgattacgagtcat | 4925 | 4944 | 1 | 5 |
| SEQ ID NO: 2817 acttccaatttccctgtgg | 3686 | 3705 | SEQ ID NO: | 4155 ccacgaaaaatatggaagt | 10368 | 10387 | 1 | 5 |
| SEQ ID NO: 2818 agttgcaatgagctcatgg | 3811 | 3830 | SEQ ID NO: | 4156 ccatcagttcagataaact | 7997 | 8016 | 1 | 5 |
| SEQ ID NO: 2819 tttgcaagaccacctcaat | 3868 | 3887 | SEQ ID NO: | 4157 attgacctgtccattcaaa | 13679 | 13698 | 1 | 5 |
| SEQ ID NO: 2820 gaaggagttcaacctccag | 3892 | 3911 | SEQ ID NO: | 4158 ctggaattgtcattccttc | 11736 | 11755 | 1 | 5 |
| SEQ ID NO: 2821 acttccacatcccagacaa | 3927 | 3946 | SEQ ID NO: | 4159 ttttaacaaaagtggaagt | 6829 | 6848 | 1 | 5 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 2822 ctcttcttaaaaagcgatg | 3947 | 3966 | SEQ ID NO: | 4160 catcactgccaaaggagag | 8494 | 8513 | 1 | 5 |
| SEQ ID NO: 2823 aaaagcgatggccgggtca | 3956 | 3975 | SEQ ID NO: | 4161 tgactcactcattgatttt | 12688 | 12707 | 1 | 5 |
| SEQ ID NO: 2824 ttcctttgccttttggtgg | 4011 | 4030 | SEQ ID NO: | 4162 ccacaaacaatgaagggaa | 9264 | 9283 | 1 | 5 |
| SEQ ID NO: 2825 caagtctgtgggattccat | 4087 | 4106 | SEQ ID NO: | 4163 atgggaaaaaacaggcttg | 9574 | 9593 | 1 | 5 |
| SEQ ID NO: 2826 aagtccctacttttaccat | 4125 | 4144 | SEQ ID NO: | 4164 atgggaagtataagaactt | 4842 | 4861 | 1 | 5 |
| SEQ ID NO: 2827 tgcctctcctgggtgttct | 4167 | 4186 | SEQ ID NO: | 4165 agaaaaacaaacacaggca | 9651 | 9670 | 1 | 5 |
| SEQ ID NO: 2828 accagcacagaccatttca | 4250 | 4269 | SEQ ID NO: | 4166 tgaagtgtagtctcctggt | 5097 | 5116 | 1 | 5 |
| SEQ ID NO: 2829 ccagcacagaccatttcag | 4251 | 4270 | SEQ ID NO: | 4167 ctgaaatacaatgctctgg | 5519 | 5538 | 1 | 5 |
| SEQ ID NO: 2830 actatcatgtgatgggtct | 4375 | 4394 | SEQ ID NO: | 4168 agacacctgattttatagt | 7956 | 7975 | 1 | 5 |
| SEQ ID NO: 2831 accacagatgtctgcttca | 4504 | 4523 | SEQ ID NO: | 4169 tgaaggctgactctgtggt | 4290 | 4309 | 1 | 5 |
| SEQ ID NO: 2832 ccacagatgtctgcttcag | 4505 | 4524 | SEQ ID NO: | 4170 ctgagcaacaaatttgtgt | 10319 | 10338 | 1 | 5 |
| SEQ ID NO: 2833 tttggactccaaaaagaaa | 4528 | 4547 | SEQ ID NO: | 4171 tttctctcatgattacaaa | 5941 | 5960 | 1 | 5 |
| SEQ ID NO: 2834 tcaaagaagtcaagattga | 4560 | 4579 | SEQ ID NO: | 4172 tcaaggataacgtgtttga | 12618 | 12637 | 1 | 5 |
| SEQ ID NO: 2835 atgagaactacgagctgac | 4806 | 4825 | SEQ ID NO: | 4173 gtcagatattgttgctcat | 10195 | 10214 | 1 | 5 |
| SEQ ID NO: 2836 ttaaaatctgacaccaatg | 4826 | 4845 | SEQ ID NO: | 4174 cattcattgaagatgttaa | 7350 | 7369 | 1 | 5 |
| SEQ ID NO: 2837 gaagtataagaactttgcc | 4846 | 4865 | SEQ ID NO: | 4175 ggcaaatttgaaggacttc | 12002 | 12021 | 1 | 5 |
| SEQ ID NO: 2838 aagtataagaactttgcca | 4847 | 4866 | SEQ ID NO: | 4176 tggcaaatttgaaggactt | 12001 | 12020 | 1 | 5 |
| SEQ ID NO: 2839 ttcttcagcctgctttctg | 4949 | 4968 | SEQ ID NO: | 4177 cagaatccagatacaagaa | 6892 | 6911 | 1 | 5 |
| SEQ ID NO: 2840 ctggatcactaaattccca | 4965 | 4894 | SEQ ID NO: | 4178 tgggtcttccagagccaa | 11041 | 11060 | 1 | 5 |
| SEQ ID NO: 2841 aaattaatagtggtgctca | 5022 | 5041 | SEQ ID NO: | 4179 tgagaagccccaagaattt | 6256 | 6275 | 1 | 5 |
| SEQ ID NO: 2842 agtgcaacgaccaacttga | 5081 | 5100 | SEQ ID NO: | 4180 tcaaattcctggatacact | 9856 | 9875 | 1 | 5 |
| SEQ ID NO: 2843 ctgggaagtgcttatcagg | 5246 | 5265 | SEQ ID NO: | 4181 cctgaccttcacataccag | 8318 | 8337 | 1 | 5 |
| SEQ ID NO: 2844 gcaaaaacattttcaactt | 5286 | 5305 | SEQ ID NO: | 4182 aagtaaaagaaaattttgc | 10752 | 10771 | 1 | 5 |
| SEQ ID NO: 2845 aaaaacattttcaacttca | 5288 | 5307 | SEQ ID NO: | 4183 tgaagtaaaagaaaatttt | 10750 | 10769 | 1 | 5 |
| SEQ ID NO: 2846 tcagtcaagaaggacttca | 5310 | 5329 | SEQ ID NO: | 4184 ttaaggacttccattctga | 13371 | 13390 | 1 | 5 |
| SEQ ID NO: 2847 tcaaatgacatgatgggct | 5333 | 5352 | SEQ ID NO: | 4185 agcccatcaatatcattga | 6213 | 6232 | 1 | 5 |
| SEQ ID NO: 2848 cacacaaacagtctgaaca | 5375 | 5394 | SEQ ID NO: | 4186 tgtttcaactgcctttgtg | 11227 | 11246 | 1 | 5 |
| SEQ ID NO: 2849 tcttcaaaacttgacaaca | 5417 | 5436 | SEQ ID NO: | 4187 tgttttcctatttccaaga | 12843 | 12862 | 1 | 5 |
| SEQ ID NO: 2850 caagttttataagcaaact | 5449 | 5468 | SEQ ID NO: | 4188 agttattttgctaaacttg | 14051 | 14070 | 1 | 5 |
| SEQ ID NO: 2851 tggtaactactttcaacag | 5496 | 5515 | SEQ ID NO: | 4189 ctgttttagaggaaacca | 7520 | 7539 | 1 | 5 |
| SEQ ID NO: 2852 aacagtgacctgaaataca | 5510 | 5529 | SEQ ID NO: | 4190 tgtatagcaaattcctgtt | 5898 | 5917 | 1 | 5 |
| SEQ ID NO: 2853 gggaaactacggctagaac | 5552 | 5571 | SEQ ID NO: | 4191 gttccttccatgatttccc | 10941 | 10960 | 1 | 5 |
| SEQ ID NO: 2854 aacacatctatgccatctc | 5628 | 5647 | SEQ ID NO: | 4192 gagacagcatcttcgtgtt | 11212 | 11231 | 1 | 5 |
| SEQ ID NO: 2855 tcagcaagctataaagcag | 5660 | 5679 | SEQ ID NO: | 4193 ctgctaagaaccttactga | 7788 | 7807 | 1 | 5 |
| SEQ ID NO: 2856 gcagacactgttgctaagg | 5675 | 5694 | SEQ ID NO: | 4194 cctttcaagcactgactgc | 11754 | 11773 | 1 | 5 |
| SEQ ID NO: 2857 tctggggagaacatactgg | 5874 | 5693 | SEQ ID NO: | 4195 ccaggttttccacaccaga | 8046 | 8065 | 1 | 5 |
| SEQ ID NO: 2858 ttctctcatgattacaaag | 5942 | 5961 | SEQ ID NO: | 4196 cttttttcaccaacggagaa | 10846 | 10865 | 1 | 5 |

TABLE 9-continued

Selected palindromic sequences from human ApoB

| Source | Start Index | End Index | Match Index | Start Index | End # | B | |
|---|---|---|---|---|---|---|---|
| SEQ ID NO: 2859 ctgagcagacaggcacctg | 6042 | 6061 | SEQ ID NO: 4197 caggaggctttaagttcag | 7607 | 7626 | 1 | 5 |
| SEQ ID NO: 2860 caatttaacaacaatgaat | 6074 | 6093 | SEQ ID NO: 4198 attccttcctttacaattg | 8090 | 8109 | 1 | 5 |
| SEQ ID NO: 2861 tggacgaactctggctgac | 6148 | 6167 | SEQ ID NO: 4199 gtcagcccagttccttcca | 10932 | 10951 | 1 | 5 |
| SEQ ID NO: 2862 cttttactcagtgagccca | 6200 | 6219 | SEQ ID NO: 4200 tgggctaaacgtatgaaag | 7835 | 7854 | 1 | 5 |
| SEQ ID NO: 2863 tcattgatgctttagagat | 6225 | 6244 | SEQ ID NO: 4201 atcttcataagttcaatga | 13182 | 13201 | 1 | 5 |
| SEQ ID NO: 2864 aaaaccaagatgttcactc | 6303 | 6322 | SEQ ID NO: 4202 gagtgaaatgctgtttttt | 8638 | 8657 | 1 | 5 |
| SEQ ID NO: 2865 aggaatcgacaaaccatta | 6365 | 6384 | SEQ ID NO: 4203 taatgattttcaagttcct | 8302 | 8321 | 1 | 5 |
| SEQ ID NO: 2866 tagttgtactggaaaacgt | 6384 | 6403 | SEQ ID NO: 4204 acgttagcctctaagacta | 11936 | 11955 | 1 | 5 |
| SEQ ID NO: 2867 agaaaacgtacagagaaag | 6394 | 6413 | SEQ ID NO: 4205 cttttacaattcatttttcc | 13022 | 13041 | 1 | 5 |
| SEQ ID NO: 2868 gaaaacgtacagagaaagc | 6395 | 6414 | SEQ ID NO: 4206 gctttctcttccacatttc | 10060 | 10079 | 1 | 5 |
| SEQ ID NO: 2869 aaagctgaagcacatcaat | 6409 | 6428 | SEQ ID NO: 4207 attgatgttagagtgcttt | 6992 | 7011 | 1 | 5 |
| SEQ ID NO: 2870 aagctgaagcacatcaata | 6410 | 6429 | SEQ ID NO: 4208 tattgatgttagagtgctt | 6991 | 7010 | 1 | 5 |
| SEQ ID NO: 2871 tgaagcacatcaatattga | 6414 | 6433 | SEQ ID NO: 4209 tcaaccttaatgattttca | 8295 | 8314 | 1 | 5 |
| SEQ ID NO: 2872 atcaatattgatcaatttg | 6422 | 6441 | SEQ ID NO: 4210 caaagccatcactgatgat | 1668 | 1687 | 1 | 5 |
| SEQ ID NO: 2873 taatgattatctgaattca | 6484 | 6503 | SEQ ID NO: 4211 tgaaatcattgaaaaatta | 6727 | 6746 | 1 | 5 |
| SEQ ID NO: 2874 gattatctgaattcattca | 6488 | 6507 | SEQ ID NO: 4212 tgaagtagctgagaaaatc | 7102 | 7121 | 1 | 5 |
| SEQ ID NO: 2875 aattgggagagacaagttt | 6506 | 6525 | SEQ ID NO: 4213 aaacattcctttaacaatt | 9496 | 9515 | 1 | 5 |
| SEQ ID NO: 2876 aaaatagctattgctaata | 6701 | 6720 | SEQ ID NO: 4214 tattgaaaatattgatttt | 6814 | 6833 | 1 | 5 |
| SEQ ID NO: 2877 aaaattaaaagtcttgat | 6739 | 6758 | SEQ ID NO: 4215 atcatatccgtgtaatttt | 6765 | 6784 | 1 | 5 |
| SEQ ID NO: 2878 ttgaaaatattgattttaa | 6816 | 6835 | SEQ ID NO: 4216 ttaatcttcataagttcaa | 13179 | 13198 | 1 | 5 |
| SEQ ID NO: 2879 agacatccagcacctagct | 6946 | 6965 | SEQ ID NO: 4217 agcttggttttgccagtct | 2466 | 2485 | 1 | 5 |
| SEQ ID NO: 2880 caatttcatttgaaagaat | 7029 | 7048 | SEQ ID NO: 4218 attccttcctttacaattg | 8090 | 8109 | 1 | 5 |
| SEQ ID NO: 2881 aggttttaatggataaatt | 7182 | 7201 | SEQ ID NO: 4219 aattgttgaaagaaaacct | 13155 | 13174 | 1 | 5 |
| SEQ ID NO: 2882 cagaagctaagcaatgtcc | 7241 | 7260 | SEQ ID NO: 4220 ggacaaggcccagaatctg | 12553 | 12572 | 1 | 5 |
| SEQ ID NO: 2883 taagataaaagattacttt | 7270 | 7289 | SEQ ID NO: 4221 aaagaaaacctatgcctta | 13163 | 13182 | 1 | 5 |
| SEQ ID NO: 2884 aaagattattttgagaaat | 7277 | 7296 | SEQ ID NO: 4222 atttcttaaacattcctttt | 9489 | 9508 | 1 | 5 |
| SEQ ID NO: 2885 gagaaattagttggattta | 7289 | 7308 | SEQ ID NO: 4223 taaagccattcagtctctc | 12970 | 12989 | 1 | 5 |
| SEQ ID NO: 2886 atttattgatgatgctgtc | 7303 | 7322 | SEQ ID NO: 4224 gacatgttgataaagaaat | 7379 | 7398 | 1 | 5 |
| SEQ ID NO: 2887 gaattatcttttaaaacat | 7334 | 7353 | SEQ ID NO: 4225 atgtatcaaatggacattc | 7685 | 7704 | 1 | 5 |
| SEQ ID NO: 2888 ttaccaccgtttgtagat | 7411 | 7430 | SEQ ID NO: 4226 atctggaaccttgaagtaa | 10739 | 10758 | 1 | 5 |
| SEQ ID NO: 2889 ttgcagtgtatctggaaag | 7548 | 7567 | SEQ ID NO: 4227 cttttcacattagatgcaa | 8420 | 8439 | 1 | 5 |
| SEQ ID NO: 2890 cattcagcaggaacttcaa | 7699 | 7718 | SEQ ID NO: 4228 ttgaaggacttcaggaatg | 12009 | 12028 | 1 | 5 |
| SEQ ID NO: 2891 acacctgatttttatagtcc | 7958 | 7977 | SEQ ID NO: 4229 ggactcaaggataacgtgt | 12614 | 12633 | 1 | 5 |
| SEQ ID NO: 2892 ggattccatcagttcagat | 7992 | 8011 | SEQ ID NO: 4230 atcttcaatgattatatcc | 13124 | 13143 | 1 | 5 |
| SEQ ID NO: 2893 ttgtagaaatgaaagtaaa | 8112 | 8131 | SEQ ID NO: 4231 tttatgattatgtcaacaa | 12360 | 12379 | 1 | 5 |
| SEQ ID NO: 2894 ctgaacagtgagctgcagt | 8156 | 8175 | SEQ ID NO: 4232 actggacttctctagtcag | 8809 | 8828 | 1 | 5 |
| SEQ ID NO: 2895 aatccaatctcctctttc | 8407 | 8426 | SEQ ID NO: 4233 gaaaaatgaagtccggatt | 11017 | 11036 | 1 | 5 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 2896 attttgattttcaagcaaa | 8532 | 8551 | SEQ ID NO: | 4234 tttgcaagttaaagaaaat | 14023 | 14042 | 1 | 5 |
| SEQ ID NO: 2897 ttttgattttcaagcaaat | 8533 | 8552 | SEQ ID NO: | 4235 atttgatttaagtgtaaaa | 9622 | 9841 | 1 | 5 |
| SEQ ID NO: 2898 tgattttcaagcaaatgca | 8536 | 8555 | SEQ ID NO: | 4236 tgcaagttaaagaaaatca | 14025 | 14044 | 1 | 5 |
| SEQ ID NO: 2899 atgctgtttttggaaatg | 8645 | 8664 | SEQ ID NO: | 4237 cattggtaggagacagcat | 11203 | 11222 | 1 | 5 |
| SEQ ID NO: 2900 tgctgtttttggaaatgc | 8646 | 8665 | SEQ ID NO: | 4238 gcattggtaggagacagca | 11202 | 11221 | 1 | 5 |
| SEQ ID NO: 2901 aaaaaaatacactggagct | 8706 | 8725 | SEQ ID NO: | 4239 agctagagggcctcttttt | 10833 | 10852 | 1 | 5 |
| SEQ ID NO: 2902 actggagcttagtaatgga | 8716 | 8735 | SEQ ID NO: | 4240 tccactcacatcctccagt | 1289 | 1308 | 1 | 5 |
| SEQ ID NO: 2903 cttctggaaaagggtcatg | 8886 | 8905 | SEQ ID NO: | 4241 catgaaccctacatgaag | 13759 | 13778 | 1 | 5 |
| SEQ ID NO: 2904 ggaaaagggtcatggaaat | 8891 | 8910 | SEQ ID NO: | 4242 atttgaaagttcgttttcc | 9282 | 9301 | 1 | 5 |
| SEQ ID NO: 2905 gggcctgccccagattctc | 8910 | 8929 | SEQ ID NO: | 4243 gagaacattatggaggccc | 9440 | 9459 | 1 | 5 |
| SEQ ID NO: 2906 ttctcagatgagggaacac | 8924 | 8943 | SEQ ID NO: | 4244 gtgtcttcaaagctgaaa | 12416 | 12435 | 1 | 5 |
| SEQ ID NO: 2907 gatgagggaacacatgaat | 8930 | 8949 | SEQ ID NO: | 4245 attccagcttccccacatc | 8338 | 8357 | 1 | 5 |
| SEQ ID NO: 2908 ctttggactgtccaataag | 8986 | 9005 | SEQ ID NO: | 4246 cttatgggatttcctaaag | 11167 | 11186 | 1 | 5 |
| SEQ ID NO: 2909 gcatccacaaacaatgaag | 9260 | 9279 | SEQ ID NO: | 4247 cttcatctgtcattgatgc | 10227 | 10246 | 1 | 5 |
| SEQ ID NO: 2910 cacaaacaatgaagggaat | 9265 | 9284 | SEQ ID NO: | 4248 attccctgaagttgatgtg | 11488 | 11507 | 1 | 5 |
| SEQ ID NO: 2911 ccaaaatttctctgctgga | 9415 | 9434 | SEQ ID NO: | 4249 tccatcacaaatcctttgg | 9671 | 9690 | 1 | 5 |
| SEQ ID NO: 2912 caaaatttctctgctgaa | 9416 | 9435 | SEQ ID NO: | 4250 ttccatcacaaatcctttg | 9670 | 9689 | 1 | 5 |
| SEQ ID NO: 2913 tctgctggaaacaacgaga | 9425 | 9444 | SEQ ID NO: | 4251 tctcaagagttacagcaga | 13229 | 13248 | 1 | 5 |
| SEQ ID NO: 2914 ctgctggaaacaacgagaa | 9426 | 9445 | SEQ ID NO: | 4252 ttctcaagagttacagcag | 13228 | 13247 | 1 | 5 |
| SEQ ID NO: 2915 agaacattatggaggccca | 9441 | 9460 | SEQ ID NO: | 4253 tgggcctgccccagattct | 8909 | 8928 | 1 | 5 |
| SEQ ID NO: 2916 agaagcaaatctggatttc | 9475 | 9494 | SEQ ID NO: | 4254 gaaatcttcaatttattct | 13821 | 13840 | 1 | 5 |
| SEQ ID NO: 2917 ttttctctctatgggaaaaa | 9565 | 9584 | SEQ ID NO: | 4255 tttttgcaagttaaagaaa | 14021 | 14040 | 1 | 5 |
| SEQ ID NO: 2918 tcagagcatcaaatccttt | 9712 | 9731 | SEQ ID NO: | 4256 aaagaaaatcaggatctga | 14033 | 14052 | 1 | 5 |
| SEQ ID NO: 2919 cagaaacaatgcattagat | 9751 | 9770 | SEQ ID NO: | 4257 atctatgccatctcttct | 5633 | 5652 | 1 | 5 |
| SEQ ID NO: 2920 tacacattaatcctgccat | 10001 | 10020 | SEQ ID NO: | 4258 atggagtctttattgtgta | 14089 | 14108 | 1 | 5 |
| SEQ ID NO: 2921 agtcagatattgttgctca | 10194 | 10213 | SEQ ID NO: | 4259 tgagaactacgagctgact | 4807 | 4826 | 1 | 5 |
| SEQ ID NO: 2922 ggagggtagtcataacagt | 10336 | 10355 | SEQ ID NO: | 4260 actggtggcaaaaccctcc | 2734 | 2753 | 1 | 5 |
| SEQ ID NO: 2923 caaaagccgaaattccaat | 10404 | 10423 | SEQ ID NO: | 4261 attgaagtacctacttttg | 8366 | 8385 | 1 | 5 |
| SEQ ID NO: 2924 aaaagccgaaattccaatt | 10405 | 10424 | SEQ ID NO: | 4262 aattgaagtacctactttt | 8365 | 8384 | 1 | 5 |
| SEQ ID NO: 2925 ttcaagcaagaacttaatg | 10436 | 10455 | SEQ ID NO: | 4263 cattatggcccttcgtgaa | 13258 | 13277 | 1 | 5 |
| SEQ ID NO: 2926 cctcttacttttccattga | 10578 | 10597 | SEQ ID NO: | 4264 tcaaaagaagcccaagagg | 12947 | 12966 | 1 | 5 |
| SEQ ID NO: 2927 tgaggccaacacttacttg | 10663 | 10682 | SEQ ID NO: | 4265 caagcatctgattgactca | 12676 | 12695 | 1 | 5 |
| SEQ ID NO: 2928 cacttacttgaattccaag | 10672 | 10691 | SEQ ID NO: | 4266 cttgaacacaaagtcagtg | 6008 | 6027 | 1 | 5 |
| SEQ ID NO: 2929 gaagtaaagaaaattttg | 10751 | 10770 | SEQ ID NO: | 4267 caaaaacattttcaacttc | 5287 | 5306 | 1 | 5 |
| SEQ ID NO: 2930 cctggaactctctccatgg | 10882 | 10901 | SEQ ID NO: | 4268 ccatttacagatcttcagg | 11372 | 11391 | 1 | 5 |
| SEQ ID NO: 2931 agctggatgtaaccaccag | 11184 | 11203 | SEQ ID NO: | 4269 ctggattccacatgcagct | 11855 | 11874 | 1 | 5 |
| SEQ ID NO: 2932 aaaattccctgaagttgat | 11485 | 11504 | SEQ ID NO: | 4270 atcatatccgtgtaatttt | 6765 | 6784 | 1 | 5 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 2933 cagatggcattgctgctttt | 11613 | 11632 | SEQ ID NO: 4271 aaagctgagaagaaatctg | | 12424 | 12443 | 1 | 5 |
| SEQ ID NO: 2934 agatggcattgctgcttttg | 11614 | 11633 | SEQ ID NO: 4272 caaagctgagaagaaatct | | 12423 | 12442 | 1 | 5 |
| SEQ ID NO: 2935 tgttgaaacagtcctggat | 11842 | 11861 | SEQ ID NO: 4273 atccaagatgagatcaaca | | 13103 | 13122 | 1 | 5 |
| SEQ ID NO: 2936 catattcaaaactgagttg | 12229 | 12248 | SEQ ID NO: 4274 caactctctgattactatg | | 13631 | 13650 | 1 | 5 |
| SEQ ID NO: 2937 aaagatttatcaaaagaag | 12938 | 12957 | SEQ ID NO: 4275 cttcaatttattcttcttt | | 13826 | 13845 | 1 | 5 |
| SEQ ID NO: 2938 attttccaactaatagaag | 13034 | 13053 | SEQ ID NO: 4276 cttcaaagacttaaaaaat | | 8014 | 8033 | 1 | 5 |
| SEQ ID NO: 2939 aattatatccaagatgaga | 13097 | 13116 | SEQ ID NO: 4277 tctcttcctccatggaatt | | 10479 | 10498 | 1 | 5 |
| SEQ ID NO: 2940 ttcaggacgcttctcaaga | 13218 | 13237 | SEQ ID NO: 4278 tcttcataagttcaatgaa | | 13183 | 13202 | 1 | 5 |
| SEQ ID NO: 2941 ttgagcaatttctgcacag | 13437 | 13456 | SEQ ID NO: 4279 ctgttgaaagatttatcaa | | 12932 | 12951 | 1 | 5 |
| SEQ ID NO: 2942 ctgatatacatcacggagt | 13712 | 13731 | SEQ ID NO: 4280 actcaatggtgaaattcag | | 7465 | 7484 | 1 | 5 |
| SEQ ID NO: 2943 acatcacggagttactgaa | 13719 | 13738 | SEQ ID NO: 4281 ttcagaagctaagcaatgt | | 7239 | 7258 | 1 | 5 |
| SEQ ID NO: 2944 actgcctatattgataaaa | 13882 | 13901 | SEQ ID NO: 4282 ttttggcaagctatacagt | | 8380 | 8399 | 1 | 5 |
| SEQ ID NO: 2945 aggatggcatttttttgcaa | 14011 | 14030 | SEQ ID NO: 4283 ttgcaagcaagtctttcct | | 3013 | 3032 | 1 | 5 |
| SEQ ID NO: 2946 ttttttgcaagttaaagaa | 14020 | 14039 | SEQ ID NO: 4284 ttctctctatgggaaaaaa | | 9566 | 9585 | 1 | 5 |
| SEQ ID NO: 2947 tccagaactcaagtcttca | 1627 | 1646 | SEQ ID NO: 4285 tgaaatgctgtttttgga | | 8641 | 8660 | 3 | 4 |
| SEQ ID NO: 2948 agttagtgaaagaagttct | 1956 | 1975 | SEQ ID NO: 4286 agaatctgtaccaggaact | | 12564 | 12583 | 3 | 4 |
| SEQ ID NO: 2949 atttacagctctgacaagt | 5435 | 5454 | SEQ ID NO: 4287 acttcagagaaatacaaat | | 11409 | 11428 | 3 | 4 |
| SEQ ID NO: 2950 gattatctgaattcattca | 6488 | 6507 | SEQ ID NO: 4288 tgaaaccaatgacaaaatc | | 7429 | 7448 | 3 | 4 |
| SEQ ID NO: 2951 gtgcccttctcggttgctg | 26 | 45 | SEQ ID NO: 4289 cagctgagcagacaggcac | | 8039 | 6058 | 2 | 4 |
| SEQ ID NO: 2952 attcaagcacctccggaag | 253 | 272 | SEQ ID NO: 4290 cttcataagttcaatgaat | | 13184 | 13203 | 2 | 4 |
| SEQ ID NO: 2953 gactgctgattcaagaagt | 316 | 335 | SEQ ID NO: 4291 acttcccaactctcaagtc | | 13415 | 13434 | 2 | 4 |
| SEQ ID NO: 2954 ttgctgcagccatgtccag | 483 | 502 | SEQ ID NO: 4292 ctgggcagctgtatagcaa | | 5889 | 5908 | 2 | 4 |
| SEQ ID NO: 2955 agaaagatgaacctactta | 555 | 574 | SEQ ID NO: 4293 taagtatgatttcaattct | | 10498 | 10517 | 2 | 4 |
| SEQ ID NO: 2956 tgaagactctccaggaact | 1095 | 1114 | SEQ ID NO: 4294 agttcaatgaatttattca | | 13191 | 13210 | 2 | 4 |
| SEQ ID NO: 2957 atctctcttgccacagctg | 1210 | 1229 | SEQ ID NO: 4295 cagcccagccatttgagat | | 9237 | 9256 | 2 | 4 |
| SEQ ID NO: 2958 tctctcttgccacagctga | 1211 | 1230 | SEQ ID NO: 4296 tcagcccagccatttgaga | | 9236 | 9255 | 2 | 4 |
| SEQ ID NO: 2959 tgaggtgtccagcccatc | 1231 | 1250 | SEQ ID NO: 4297 gatgggaaagccgccctca | | 5216 | 5235 | 2 | 4 |
| SEQ ID NO: 2960 ccagaactcaagtcttcaa | 1628 | 1647 | SEQ ID NO: 4298 ttgaaagcagaacctctgg | | 5915 | 5934 | 2 | 4 |
| SEQ ID NO: 2961 ctgaaaaagttagtgaaag | 1949 | 1968 | SEQ ID NO: 4299 cttttctcgggaatattcag | | 10631 | 10650 | 2 | 4 |
| SEQ ID NO: 2962 ttttttcccagacagtgtca | 2246 | 2265 | SEQ ID NO: 4300 tgacaggcatttttgaaaaa | | 9730 | 9749 | 2 | 4 |
| SEQ ID NO: 2963 ttttccccagacagtgtcaa | 2247 | 2266 | SEQ ID NO: 4301 ttgacaggcatttttgaaaa | | 9729 | 9748 | 2 | 4 |
| SEQ ID NO: 2964 cattcagaaccagaaaatt | 3403 | 3422 | SEQ ID NO: 4302 aattccaattttgagaatg | | 10414 | 10433 | 2 | 4 |
| SEQ ID NO: 2965 tgaagagaagattgaattt | 3628 | 3647 | SEQ ID NO: 4303 aaatgtcagctcttgttca | | 10902 | 10921 | 2 | 4 |
| SEQ ID NO: 2966 tttgaatggaacacaggca | 3644 | 3663 | SEQ ID NO: 4304 tgccagtttgaaaacaaa | | 11815 | 11834 | 2 | 4 |
| SEQ ID NO: 2967 ttctagattcgaatatcaa | 4407 | 4426 | SEQ ID NO: 4305 ttgacatgttgataaagaa | | 7377 | 7396 | 2 | 4 |
| SEQ ID NO: 2968 gattcgaatatcaaattca | 4412 | 4431 | SEQ ID NO: 4306 tgaagtagaccaacaaatc | | 7182 | 7181 | 2 | 4 |
| SEQ ID NO: 2969 tgcaacgaccaacttgaag | 5083 | 5102 | SEQ ID NO: 4307 cttcaggttccatcgtgca | | 11384 | 11403 | 2 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 2970 ttaagctctcaaatgacat | 5325 | 5344 | SEQ ID NO: 4308 atgttgataaagaaattaa | | 7382 | 7401 | 2 | 4 |
| SEQ ID NO: 2971 caatttaacaacaatgaat | 6074 | 6093 | SEQ ID NO: 4309 attcaaactgcctatattg | | 13876 | 13895 | 2 | 4 |
| SEQ ID NO: 2972 tgaatacagccaggacttg | 6088 | 6107 | SEQ ID NO: 4310 caagagcacacggtcttca | | 10687 | 10706 | 2 | 4 |
| SEQ ID NO: 2973 catcaatattgatcaattt | 6421 | 6440 | SEQ ID NO: 4311 aaattccctgaagttgatg | | 11486 | 11505 | 2 | 4 |
| SEQ ID NO: 2974 ttgagcatgtcaaacactt | 7059 | 7078 | SEQ ID NO: 4312 aagtaagtgctaggttcaa | | 9381 | 9400 | 2 | 4 |
| SEQ ID NO: 2975 tgaaggagactattcagaa | 7227 | 7248 | SEQ ID NO: 4313 ttctgcacagaaatattca | | 13446 | 13465 | 2 | 4 |
| SEQ ID NO: 2976 ttcaggctcttcagaaagc | 7929 | 7948 | SEQ ID NO: 4314 gcttgctaacctctctgaa | | 12312 | 12331 | 2 | 4 |
| SEQ ID NO: 2977 tccacaaattgaacatccc | 8787 | 8808 | SEQ ID NO: 4315 gggacctaccaagagtgga | | 12533 | 12552 | 2 | 4 |
| SEQ ID NO: 2978 tgaataccaatgctgaact | 10167 | 10186 | SEQ ID NO: 4316 agttcaatgaatttattca | | 13191 | 13210 | 2 | 4 |
| SEQ ID NO: 2979 taaactaatagatgtaatc | 12898 | 12917 | SEQ ID NO: 4317 gattactatgaaaaattta | | 13640 | 13659 | 2 | 4 |
| SEQ ID NO: 2980 ttgacctgtccattcaaaa | 13680 | 13699 | SEQ ID NO: 4318 ttttaaaagaaatcttcaa | | 13813 | 13832 | 2 | 4 |
| SEQ ID NO: 2981 gggctgagtgcccttctcg | 19 | 38 | SEQ ID NO: 4319 cgaggccaggccgcagccc | | 84 | 103 | 1 | 4 |
| SEQ ID NO. 2982 ggctgagtgcccttctcgg | 20 | 39 | SEQ ID NO: 4320 ccgaggccaggccgcagcc | | 83 | 102 | 1 | 4 |
| SEQ ID NO: 2983 ctgagtgcccttctcggtt | 22 | 41 | SEQ ID NO: 4321 aaccgtgcctgaatctcag | | 11557 | 11576 | 1 | 4 |
| SEQ ID NO: 2984 tctcggttgctgccgctga | 33 | 52 | SEQ ID NO: 4322 tcagctgacctcatcgaga | | 2168 | 2187 | 1 | 4 |
| SEQ ID NO: 2985 caggccgcagcccaggagc | 90 | 109 | SEQ ID NO: 4323 gctctgcagcttcatcctg | | 376 | 395 | 1 | 4 |
| SEQ ID NO: 2986 gctggcgctgcctgcgctg | 151 | 170 | SEQ ID NO: 4324 cagcacagaccatttcagc | | 4252 | 4271 | 1 | 4 |
| SEQ ID NO: 2987 tgctgctggcgggcgccag | 177 | 196 | SEQ ID NO: 4325 ctggatgtaaccaccagca | | 11186 | 11205 | 1 | 4 |
| SEQ ID NO: 2988 ctggtctgtccaaaagatg | 227 | 246 | SEQ ID NO: 4326 catcctgaagaccagccag | | 388 | 407 | 1 | 4 |
| SEQ ID NO: 2989 ctgagagttccagtggagt | 291 | 310 | SEQ ID NO: 4327 actcaccctggacattcag | | 3391 | 3410 | 1 | 4 |
| SEQ ID NO: 2990 tccagtggagtccctggga | 299 | 318 | SEQ ID NO: 4328 tcccggagccaaggctgga | | 2683 | 2702 | 1 | 4 |
| SEQ ID NO: 2991 aggttgagctggaggttcc | 354 | 373 | SEQ ID NO: 4329 ggaaccctctccctcacct | | 4736 | 4755 | 1 | 4 |
| SEQ ID NO: 2992 tgagctggaggttccccag | 358 | 377 | SEQ ID NO: 4330 ctgggaggcatgatgctca | | 9171 | 9190 | 1 | 4 |
| SEQ ID NO: 2993 tctgcagcttcatcctgaa | 378 | 397 | SEQ ID NO: 4331 ttcaaatataatcggaga | | 3269 | 3288 | 1 | 4 |
| SEQ ID NO: 2994 gccagtgcaccctgaaaga | 402 | 421 | SEQ ID NO: 4332 tcttccgttctgtaatggc | | 5802 | 5821 | 1 | 4 |
| SEQ ID NO: 2995 ctctgaggagtttgctgca | 472 | 491 | SEQ ID NO: 4333 tgcaagaatattttgagag | | 6348 | 6367 | 1 | 4 |
| SEQ ID NO: 2996 aggtatgagctcaagctgg | 500 | 519 | SEQ ID NO: 4334 ccagtttccggggaaacct | | 12724 | 12743 | 1 | 4 |
| SEQ ID NO: 2997 tcctttacccggagaaaga | 543 | 562 | SEQ ID NO: 4335 tcttttgggaagcaagga | | 2227 | 2246 | 1 | 4 |
| SEQ ID NO: 2998 catcaagagggcatcatt | 583 | 602 | SEQ ID NO: 4336 aatggtcaagttcctgatg | | 2285 | 2304 | 1 | 4 |
| SEQ ID NO: 2999 tcctggttcccccagagac | 609 | 628 | SEQ ID NO: 4337 gtctctgaactcagaagga | | 13996 | 14015 | 1 | 4 |
| SEQ ID NO: 3000 aagaagccaagcaagtgtt | 630 | 649 | SEQ ID NO: 4338 aacaaataaatggagtctt | | 14080 | 14099 | 1 | 4 |
| SEQ ID NO: 3001 aagcaagtgttgtttctgg | 638 | 657 | SEQ ID NO: 4339 ccagagccaggtcgagctt | | 11050 | 11069 | 1 | 4 |
| SEQ ID NO: 3002 tctggataccgtgtatgga | 652 | 671 | SEQ ID NO: 4340 tccatgtcccatttacaga | | 11364 | 11383 | 1 | 4 |
| SEQ ID NO: 3003 ccactcactttaccgtcaa | 678 | 697 | SEQ ID NO: 4341 ttgattttaacaaaagtgg | | 6825 | 6844 | 1 | 4 |
| SEQ ID NO: 3004 aggaagggcaatgtggcaa | 701 | 720 | SEQ ID NO: 4342 ttgcaagcaagtctttcct | | 3013 | 3032 | 1 | 4 |
| SEQ ID NO: 3005 gcaatgtggcaacagaaat | 708 | 727 | SEQ ID NO: 4343 atttccatacccgtttgc | | 3488 | 3507 | 1 | 4 |
| SEQ ID NO: 3006 caatgtggcaacagaaata | 709 | 728 | SEQ ID NO: 4344 tattcttcttttccaattg | | 13834 | 13853 | 1 | 4 |

TABLE 9-continued

Selected palindromic sequences from human ApoB

| Source | Start Index | End Index | Match | Start Index | End # | B | |
|---|---|---|---|---|---|---|---|
| SEQ ID NO: 3007 tggcaacagaaatatccac | 714 | 733 | SEQ ID NO: 4345 gtggcttcccatattgcca | 1895 | 1914 | 1 | 4 |
| SEQ ID NO: 3008 agagacctgggccagtgtg | 737 | 756 | SEQ ID NO: 4348 cacattacatttggtctct | 2938 | 2957 | 1 | 4 |
| SEQ ID NO: 3009 tgtgatcgcttcaagccca | 752 | 771 | SEQ ID NO: 4349 tgggaaagccgccctcaca | 5218 | 5237 | 1 | 4 |
| SEQ ID NO: 3010 gtgatcgcttaaagcccat | 753 | 772 | SEQ ID NO: 4350 atgggaaagccgccctcac | 5217 | 5236 | 1 | 4 |
| SEQ ID NO: 3011 cagcccacttgctctcatc | 784 | 803 | SEQ ID NO: 4351 gatgctgaacagtgagctg | 8152 | 8171 | 1 | 4 |
| SEQ ID NO: 3012 gctctcatcaaaggcatga | 794 | 813 | SEQ ID NO: 4352 tcataacagtactgtgagc | 10345 | 10364 | 1 | 4 |
| SEQ ID NO: 3013 ccttgtcaactctgatcag | 819 | 838 | SEQ ID NO: 4353 ctgagtgggtttatcaagg | 12453 | 12472 | 1 | 4 |
| SEQ ID NO: 3014 cttgtcaactctgatcagc | 820 | 839 | SEQ ID NO: 4354 gctgagtgggtttatcaag | 12452 | 12471 | 1 | 4 |
| SEQ ID NO: 3015 agccatctgcaaggagcaa | 892 | 911 | SEQ ID NO: 4355 ttgcaatgagctcatggct | 3813 | 3832 | 1 | 4 |
| SEQ ID NO: 3016 gccatctgcaaggagcaac | 893 | 912 | SEQ ID NO: 4356 cttgcaatgagctcatggc | 3812 | 3831 | 1 | 4 |
| SEQ ID NO: 3017 cttcctgcctttctcctac | 916 | 935 | SEQ ID NO: 4357 gtaggaataaatggagaag | 9461 | 9480 | 1 | 4 |
| SEQ ID NO: 3018 ctttctcctacaagaataa | 924 | 943 | SEQ ID NO: 4358 ttattgctgaatccaaaag | 13855 | 13675 | 1 | 4 |
| SEQ ID NO: 3019 gatcaacagccgcttcttt | 997 | 1016 | SEQ ID NO: 4359 aaagccatcactgatgatc | 1669 | 1688 | 1 | 4 |
| SEQ ID NO: 3020 atcaacagccgcttctttg | 998 | 1017 | SEQ ID NO: 4360 caaagccatcactgatgat | 1668 | 1687 | 1 | 4 |
| SEQ ID NO: 3021 acagccgcttctttggtga | 1002 | 1021 | SEQ ID NO: 4361 tcacaaatcctttggctgt | 9675 | 9694 | 1 | 4 |
| SEQ ID NO: 3022 aagatgggcctcgcatttg | 1031 | 1050 | SEQ ID NO: 4362 caaaatagaagggaatctt | 2077 | 2096 | 1 | 4 |
| SEQ ID NO: 3023 tgttttgaagactctccag | 1090 | 1109 | SEQ ID NO: 4363 ctggtaactactttaaaca | 5495 | 5514 | 1 | 4 |
| SEQ ID NO: 3024 ttgaagactctccaggaac | 1094 | 1113 | SEQ ID NO: 4364 gttcaatgaatttattcaa | 13102 | 13211 | 1 | 4 |
| SEQ ID NO: 3025 aactgaaaaaactaaccat | 1110 | 1129 | SEQ ID NO: 4365 atggcatttttgcaagtt | 14014 | 14033 | 1 | 4 |
| SEQ ID NO: 3026 ctgaaaaaactaaccatct | 1112 | 1131 | SEQ ID NO: 4366 agattgatgggcagttcag | 4572 | 4591 | 1 | 4 |
| SEQ ID NO: 3027 aaaactaaccatctctgag | 1117 | 1136 | SEQ ID NO: 4367 ctcaaagaatgactttttt | 2578 | 2597 | 1 | 4 |
| SEQ ID NO: 3028 tgagcaaaatatccagaga | 1132 | 1151 | SEQ ID NO: 4368 tctccagataaaaaactca | 12209 | 12228 | 1 | 4 |
| SEQ ID NO: 3029 caataagctggttactgag | 1162 | 1181 | SEQ ID NO: 4369 ctcagatcaaagttaattg | 12273 | 12292 | 1 | 4 |
| SEQ ID NO: 3030 tactgagctgagaggcctc | 1174 | 1193 | SEQ ID NO: 4370 gagggtagtcataacagta | 10337 | 10356 | 1 | 4 |
| SEQ ID NO: 3031 gcctcagtgatgaagcagt | 1188 | 1207 | SEQ ID NO: 4371 actgttgactcaggaaggc | 12580 | 12599 | 1 | 4 |
| SEQ ID NO: 3032 agtcacatctctcttgcca | 1204 | 1223 | SEQ ID NO: 4372 tggccacatagcatggact | 8866 | 8885 | 1 | 4 |
| SEQ ID NO: 3033 atctctcttgccacagctg | 1210 | 1229 | SEQ ID NO: 4373 cagctgacctcatcgagat | 2169 | 2188 | 1 | 4 |
| SEQ ID NO: 3034 tctctcttgccacagctga | 1211 | 1230 | SEQ ID NO: 4374 tcagctgacctcatcgcga | 2168 | 2187 | 1 | 4 |
| SEQ ID NO: 3035 tgccacagctgattgaggt | 1218 | 1237 | SEQ ID NO: 4375 acctgcaccaaagctggca | 13963 | 13982 | 1 | 4 |
| SEQ ID NO: 3036 gccacagctgattgaggtg | 1219 | 1238 | SEQ ID NO: 4376 caccaaaaaccccaatggc | 11248 | 11267 | 1 | 4 |
| SEQ ID NO: 3037 tcactttacaagccttggt | 1248 | 1267 | SEQ ID NO: 4377 accagatgctgaacagtga | 8148 | 8167 | 1 | 4 |
| SEQ ID NO: 3038 cccttctgatagatgtggt | 1332 | 1351 | SEQ ID NO: 4378 accacttacagctagaggg | 10824 | 10843 | 1 | 4 |
| SEQ ID NO: 3039 gtcacctacctggtggccc | 1349 | 1368 | SEQ ID NO: 4379 gggcgacctaagttgtgac | 3439 | 3458 | 1 | 4 |
| SEQ ID NO: 3040 ccttgtatgcgctgagcca | 1440 | 1459 | SEQ ID NO: 4380 tggctggtaacctaaaagg | 5586 | 5605 | 1 | 4 |
| SEQ ID NO: 3041 gacaaaccctacagggacc | 1480 | 1499 | SEQ ID NO: 4381 ggtcctttatgattatgtc | 12355 | 12374 | 1 | 4 |
| SEQ ID NO: 3042 tgctaattacctgatggaa | 1516 | 1535 | SEQ ID NO: 4382 ttcccaaaagcagtcagca | 9938 | 9957 | 1 | 4 |
| SEQ ID NO: 3043 tgactgcactggggatgaa | 1546 | 1565 | SEQ ID NO: 4383 ttcaggtccatgcaagtca | 10917 | 10936 | 1 | 4 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3044 actgcactggggatgaaga | 1548 | 1567 | SEQ ID NO: | 4384 tcttgaacacaaagtcagt | 6007 | 6026 | 1 | 4 |
| SEQ ID NO: 3045 atgaagattacacctattt | 1560 | 1579 | SEQ ID NO: | 4385 aaatgaaagtaaagatcat | 8118 | 8137 | 1 | 4 |
| SEQ ID NO: 3046 accatggagcagttaactc | 1610 | 1629 | SEQ ID NO: | 4386 gagtaaaccaaaacttggt | 9024 | 9043 | 1 | 4 |
| SEQ ID NO: 3047 gcagttaactccagaactc | 1618 | 1637 | SEQ ID NO: | 4387 gagttactgaaaaagctgc | 13727 | 13746 | 1 | 4 |
| SEQ ID NO: 3048 cagaactcaagtcttcaat | 1629 | 1648 | SEQ ID NO: | 4388 attggatatccaagatctg | 1933 | 1952 | 1 | 4 |
| SEQ ID NO: 3049 caggctctgcggaaaatgg | 1703 | 1722 | SEQ ID NO: | 4389 ccatgacctccagctcctg | 2485 | 2504 | I | 4 |
| SEQ ID NO: 3050 ccaggaggttcttcttcag | 1738 | 1757 | SEQ ID NO: | 4390 ctgaaatacaatgctctgg | 5519 | 5538 | 1 | 4 |
| SEQ ID NO: 3051 ggttcttcttcagactttc | 1744 | 1763 | SEQ ID NO: | 4391 gaaaaacttggaaacaacc | 4439 | 4458 | 1 | 4 |
| SEQ ID NO: 3052 tttccttgatgatgcttct | 1759 | 1778 | SEQ ID NO: | 4392 agaatccagatacaagaaa | 6893 | 6912 | 1 | 4 |
| SEQ ID NO: 3053 ggagataagcgactggctg | 1781 | 1800 | SEQ ID NO: | 4393 cagcatgcctagtttctcc | 9952 | 9971 | 1 | 4 |
| SEQ ID NO: 3054 gctgccatcttatgttga | 1796 | 1815 | SEQ ID NO: | 4394 tcaatatcaaaagcccagc | 12045 | 12064 | 1 | 4 |
| SEQ ID NO: 3055 actttgtggcttcccatat | 1890 | 1909 | SEQ ID NO: | 4395 atatctggaaccttgaagt | 10737 | 10758 | 1 | 4 |
| SEQ ID NO: 3056 gccaatatcttgaactcag | 1910 | 1929 | SEQ ID NO: | 4396 ctgaactcagaaggatggc | 14000 | 14019 | 1 | 4 |
| SEQ ID NO: 3057 aatatcttgaactcagaag | 1913 | 1932 | SEQ ID NO: | 4397 cttcccttctgaatatatt | 13378 | 13397 | 1 | 4 |
| SEQ ID NO: 3058 ctcagaagaattggatatc | 1924 | 1943 | SEQ ID NO: | 4398 gataaaagattactttgag | 7273 | 7292 | 1 | 4 |
| SEQ ID NO: 3059 aagaattggatatccaaga | 1929 | 1948 | SEQ ID NO: | 4399 tcttcaatttattcttctt | 13825 | 13844 | 1 | 4 |
| SEQ ID NO: 3060 agaattggatatccaagat | 1930 | 1949 | SEQ ID NO: | 4400 atcttcaatttattcttct | 13824 | 13843 | 1 | 4 |
| SEQ ID NO: 3061 tggatatccaagatctgaa | 1935 | 1954 | SEQ ID NO: | 4401 ttcacataccagaattcca | 8325 | 8344 | 1 | 4 |
| SEQ ID NO: 3062 atatccaagatctgaaaaa | 1938 | 1957 | SEQ ID NO: | 4402 tttttaaccagtcagatat | 10185 | 10204 | 1 | 4 |
| SEQ ID NO: 3063 tatccaagatctgaaaaag | 1939 | 1958 | SEQ ID NO: | 4403 cttttaaccagtcagata | 10184 | 10203 | 1 | 4 |
| SEQ ID NO: 3064 caagatctgaaaaagttag | 1943 | 1962 | SEQ ID NO: | 4404 ctaaattcccatggtcttg | 4973 | 4962 | 1 | 4 |
| SEQ ID NO: 3065 aagatctgaaaaagttagt | 1944 | 1963 | SEQ ID NO: | 4405 actaaattcccatggtctt | 4972 | 4991 | 1 | 4 |
| SEQ ID NO: 3066 tgaaaaagttagtgaaaga | 1950 | 1969 | SEQ ID NO: | 4006 tctttctcgggaatattca | 10630 | 10649 | 1 | 4 |
| SEQ ID NO: 3067 tccaactgtcatggacttc | 1990 | 2009 | SEQ ID NO: | 4407 gaagcacatatgaactgga | 13945 | 13964 | 1 | 4 |
| SEQ ID NO: 3068 tcagaaaattctctcggaa | 2007 | 2026 | SEQ ID NO: | 4408 ttcctttaacaattcctga | 9501 | 9520 | 1 | 4 |
| SEQ ID NO: 3069 ttccatcacttgacccagc | 2052 | 2071 | SEQ ID NO: | 4409 gctgacatagggaatgaa | 8441 | 8460 | 1 | 4 |
| SEQ ID NO: 3070 cccagcctcagccaaaata | 2065 | 2084 | SEQ ID NO: | 4410 tattctatccaagattggg | 7820 | 7839 | 1 | 4 |
| SEQ ID NO: 3071 agcctcagccaaaatagaa | 2068 | 2087 | SEQ ID NO: | 4411 ttctatccaagattgggct | 7822 | 7841 | 1 | 4 |
| SEQ ID NO: 3072 atcttatatttgatccaaa | 2091 | 2110 | SEQ ID NO: | 4412 tttgaaaaacaaagcagat | 11821 | 11840 | 1 | 4 |
| SEQ ID NO: 3073 tcttatatttgatccaaat | 2092 | 2111 | SEQ ID NO: | 4413 atttttgcaagttaaaga | 14019 | 14038 | 1 | 4 |
| SEQ ID NO: 3074 cttcctaaagaaagcatgc | 2117 | 2136 | SEQ ID NO: | 4414 ccatggcattatgatgaag | 3614 | 3633 | 1 | 4 |
| SEQ ID NO: 3075 ctaaagaaagcatgctgaa | 2121 | 2140 | SEQ ID NO: | 4415 ttcagggtgtggagtttag | 5694 | 6713 | 1 | 4 |
| SEQ ID NO: 3076 taaagaaagcatgctgaaa | 2122 | 2141 | SEQ ID NO: | 4416 tttcttaaacattccttta | 9490 | 9509 | 1 | 4 |
| SEQ ID NO: 3077 gagattggcttggaaggaa | 2183 | 2202 | SEQ ID NO: | 4417 ttccctccattaagttctc | 11709 | 11728 | 1 | 4 |
| SEQ ID NO: 3078 ctttgagccaacattggaa | 2206 | 2225 | SEQ ID NO: | 4418 ttccaatgaccaagaaaag | 11068 | 11087 | 1 | 4 |
| SEQ ID NO: 3079 cagacagtgtcaacaaagc | 2253 | 2272 | SEQ ID NO: | 4419 gcttactgacgaactctg | 6142 | 6161 | 1 | 4 |
| SEQ ID NO: 3080 cagtgtcaacaaagctttg | 2257 | 2276 | SEQ ID NO: | 4420 caaattcctggatacactg | 9857 | 9876 | 1 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3081 agtgtcaacaaagctttgt | 2258 | 2277 | SEQ ID NO: | 4421 acaagaatacgtctacact | 4359 | 4378 | 1 | 4 |
| SEQ ID NO: 3082 ctgatggtgtctctaaggt | 2298 | 2317 | SEQ ID NO: | 4422 acctcggaacaatcctcag | 3333 | 3352 | 1 | 4 |
| SEQ ID NO: 3083 tgatggtgtctctaaggtc | 2299 | 2318 | SEQ ID NO: | 4423 gacctgcgcaacgagatca | 8831 | 8850 | 1 | 4 |
| SEQ ID NO: 3084 caacatgagcaggatatgg | 2351 | 2370 | SEQ ID NO: | 4424 ccatgatctacatttgttt | 6796 | 6815 | 1 | 4 |
| SEQ ID NO: 3085 gaagctgattaaagatttg | 2395 | 2414 | SEQ ID NO: | 4425 caaaaacattttcaacttc | 5287 | 5306 | 1 | 4 |
| SEQ ID NO: 3086 aaagatttgaaatccaaag | 2405 | 2424 | SEQ ID NO: | 4426 czttaagttcagcatcttt | 7614 | 7633 | 1 | 4 |
| SEQ ID NO: 3087 gatgggtgcccgcactctg | 2518 | 2537 | SEQ ID NO: | 4427 cagatttgaggattccatc | 7983 | 8002 | 1 | 4 |
| SEQ ID NO: 3088 gggatcccccagatgattg | 2540 | 2559 | SEQ ID NO: | 4428 caatcacaagtcgattccc | 9083 | 9102 | 1 | 4 |
| SEQ ID NO: 3089 ttttcttcactacatcttc | 2593 | 2612 | SEQ ID NO: | 4429 gaagtgtcagtggcaaaaa | 10382 | 10401 | 1 | 4 |
| SEQ ID NO: 3090 tcttcactacatcttcatg | 2596 | 2615 | SEQ ID NO: | 4430 catggcattatgatgaaga | 3615 | 3634 | 1 | 4 |
| SEQ ID NO: 3091 tacatcttcatggagaatg | 2603 | 2622 | SEQ ID NO: | 4431 cattatggaggcccatgta | 9445 | 9464 | 1 | 4 |
| SEQ ID NO: 3092 ttcatggagaatgcctttg | 2609 | 2628 | SEQ ID NO: | 4432 caaaatcaactttaatgaa | 6607 | 6626 | 1 | 4 |
| SEQ ID NO: 3093 tcatggagaatgcctttga | 2610 | 2629 | SEQ ID NO: | 4433 tcaacacaatcttcaatga | 13116 | 13135 | 1 | 4 |
| SEQ ID NO: 3094 tttgaactccccactggag | 2624 | 2643 | SEQ ID NO: | 4434 ctccccaggacctttcaaa | 9842 | 9861 | 1 | 4 |
| SEQ ID NO: 3095 ttgaactccccactggagc | 2625 | 2644 | SEQ ID NO: | 4435 gctccccaggacctttcaa | 9841 | 9860 | 1 | 4 |
| SEQ ID NO: 3096 tgaactccccactggagct | 2626 | 2645 | SEQ ID NO: | 4436 agctccccaggacctttca | 9840 | 9859 | 1 | 4 |
| SEQ ID NO: 3097 cactggagctggattacag | 2635 | 2654 | SEQ ID NO: | 4437 ctgtttctgagtcccagtg | 9344 | 9363 | 1 | 4 |
| SEQ ID NO: 3098 actggagctggattacagt | 2636 | 2655 | SEQ ID NO: | 4438 actgtttctgagtcccagt | 9343 | 9362 | 1 | 4 |
| SEQ ID NO: 3099 agttgcaaatatcttcatc | 2652 | 2671 | SEQ ID NO: | 4439 gatgatgccaaaatcaact | 6599 | 6618 | 1 | 4 |
| SEQ ID NO: 3100 gttgcaaatatcttcatct | 2653 | 2672 | SEQ ID NO: | 4440 agatgatgccaaaatcaac | 6598 | 6617 | 1 | 4 |
| SEQ ID NO: 3101 aaatatcttcatctggagt | 2658 | 2677 | SEQ ID NO: | 4441 actcagaaggatggcattt | 14004 | 14023 | 1 | 4 |
| SEQ ID NO: 3102 taaaactggaagtagccaa | 2703 | 2722 | SEQ ID NO: | 4442 ttggttacaggaggcttta | 7600 | 7619 | 1 | 4 |
| SEQ ID NO: 3103 ggctgaactggtggcaaaa | 2728 | 2747 | SEQ ID NO: | 4443 ttttcttttcagcccagcc | 9228 | 9247 | 1 | 4 |
| SEQ ID NO: 3104 tgtgagtttgtgacaaat | 2758 | 2777 | SEQ ID NO: | 4444 attttcaagcaaatgcaca | 8538 | 8557 | 1 | 4 |
| SEQ ID NO: 3105 ttgtgacaaatatgggcat | 2766 | 2785 | SEQ ID NO: | 4445 atgcgtctaccttacacaa | 9521 | 9540 | 1 | 4 |
| SEQ ID NO: 3106 atgaacaccaacttcttcc | 2819 | 2838 | SEQ ID NO: | 4446 ggaagctgaagtttatcat | 2877 | 2896 | 1 | 4 |
| SEQ ID NO: 3107 cttccacgagtcgggtctg | 2833 | 2852 | SEQ ID NO: | 4447 cagagctatcactgggaag | 5235 | 5254 | 1 | 4 |
| SEQ ID NO: 3108 gagtcgggtctggaggctc | 2840 | 2859 | SEQ ID NO: | 4448 gagcttactggacgaactc | 6140 | 6159 | 1 | 4 |
| SEQ ID NO: 3109 cctaaaagctgggaagctg | 2866 | 2885 | SEQ ID NO: | 4449 cagcctccccagccgtagg | 12120 | 12139 | 1 | 4 |
| SEQ ID NO: 3110 agctgggaagctgaagttt | 2872 | 2891 | SEQ ID NO: | 4450 aaactgttaatttacagct | 5463 | 5482 | 1 | 4 |
| SEQ ID NO: 3111 ccagattagagctggaact | 3114 | 3133 | SEQ ID NO: | 4451 agtttccggggaaacctgg | 12726 | 12745 | 1 | 4 |
| SEQ ID NO: 3112 ggatacctgaagtttgtg | 3208 | 3227 | SEQ ID NO: | 4452 tacagtattctgaaaatcc | 8393 | 8412 | 1 | 4 |
| SEQ ID NO: 3113 ctgaggctaccatgacatt | 3252 | 3271 | SEQ ID NO: | 4453 aatgagctcatggcttccg | 3817 | 3836 | 1 | 4 |
| SEQ ID NO: 3114 tgtccagtgaagtccaaat | 3297 | 3316 | SEQ ID NO: | 4454 attttgagaggaatcgaca | 6357 | 6376 | 1 | 4 |
| SEQ ID NO: 3115 aattccggattttgatgtt | 3313 | 3332 | SEQ ID NO: | 4455 aacacatgaatcacaaatt | 8938 | 8957 | 1 | 4 |
| SEQ ID NO: 3116 ttccggattttgatgttga | 3315 | 3334 | SEQ ID NO: | 4456 tcaaaacgagcttcaggaa | 13207 | 13226 | 1 | 4 |
| SEQ ID NO: 3117 cggaacaatcctcagagtt | 3337 | 3356 | SEQ ID NO: | 4457 aacttgtacaactggtccg | 4211 | 4230 | 1 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3118 tcctcagagttaatgatga | 3345 | 3364 | SEQ ID NO: 4458 tcatcaattggttacagga | | 7593 | 7612 | 1 | 4 |
| SEQ ID NO: 3119 ctcaccctggacattcaga | 3392 | 3411 | SEQ ID NO: 4459 tctgcagaacaatgctgag | | 12439 | 12458 | 1 | 4 |
| SEQ ID NO: 3120 cattcagaacaagaaaatt | 3403 | 3422 | SEQ ID NO: 4460 aattgactttgtagaaatg | | 8104 | 8123 | 1 | 4 |
| SEQ ID NO: 3121 actgaggtcgccctcatgg | 3422 | 3441 | SEQ ID NO: 4461 ccatgcaagtcagcccagt | | 10924 | 10943 | 1 | 4 |
| SEQ ID NO: 3122 ttatttccatacccgttt | 3486 | 3505 | SEQ ID NO: 4462 aaactgcctatattgataa | | 13880 | 13899 | 1 | 4 |
| SEQ ID NO: 3123 gtttgcaagcagaagccag | 3501 | 3520 | SEQ ID NO: 4463 ctggacttctcttcaaaac | | 5408 | 5427 | 1 | 4 |
| SEQ ID NO: 3124 tttgcaagcagaagccaga | 3502 | 3521 | SEQ ID NO: 4464 tctgggtgtcgacagcaaa | | 5272 | 5291 | 1 | 4 |
| SEQ ID NO: 3125 ttgcaagcagaagccagaa | 3503 | 3522 | SEQ ID NO: 4467 ttctgggtgtcgacagcaa | | 5271 | 5290 | 1 | 4 |
| SEQ ID NO: 3126 ctgcttctccaaatggact | 3554 | 3573 | SEQ ID NO: 4466 agtcaagattgatgggcag | | 4567 | 4586 | 1 | 4 |
| SEQ ID NO: 3127 tgctacagcttatggctcc | 3577 | 3596 | SEQ ID NO: 4467 ggaggctttaagttcagca | | 7609 | 7628 | 1 | 4 |
| SEQ ID NO: 3128 acagcttatggctccacag | 3581 | 3600 | SEQ ID NO: 4468 ctgtatagcaaattcctgt | | 5897 | 5916 | 1 | 4 |
| SEQ ID NO: 3129 tttccaagagggtggcatg | 3600 | 3619 | SEQ ID NO: 4469 catggacttcttctggaaa | | 8877 | 8896 | 1 | 4 |
| SEQ ID NO: 3130 ccaagagggtggcatgca | 3603 | 3622 | SEQ ID NO: 4470 tgcccagcaagcaagttgg | | 9361 | 9380 | 1 | 4 |
| SEQ ID NO: 3131 gtggcatggcattatgatg | 3611 | 3630 | SEQ ID NO: 4471 catccttaacaccttccac | | 8071 | 8090 | 1 | 4 |
| SEQ ID NO: 3132 tgatgaagaagattgaa | 3625 | 3644 | SEQ ID NO: 4472 ttcactgttcctgaaatca | | 7871 | 7890 | 1 | 4 |
| SEQ ID NO: 3133 gaagagaagattgaatttg | 3629 | 3648 | SEQ ID NO: 4473 caaaaacattttcaacttc | | 5287 | 5306 | 1 | 4 |
| SEQ ID NO: 3134 gagaagattgaatttgaat | 3632 | 3651 | SEQ ID NO: 4474 attcataatcccaactctc | | 8278 | 8297 | 1 | 4 |
| SEQ ID NO: 3135 tttgaatggaacacaggca | 3644 | 3663 | SEQ ID NO: 4475 tgcctttgtgtacaccaaa | | 11236 | 11255 | 1 | 4 |
| SEQ ID NO: 3136 aggcaccaatgtagatacc | 3658 | 3677 | SEQ ID NO: 4476 ggtaacctaaaaggagcct | | 5591 | 5610 | 1 | 4 |
| SEQ ID NO: 3137 caaaaaaatgacttccaat | 3676 | 3695 | SEQ ID NO: 4477 attgaagtacctactttg | | 8366 | 8385 | 1 | 4 |
| SEQ ID NO: 3138 aaaaaaatgacttccaatt | 3677 | 3696 | SEQ ID NO: 4478 aattgaagtacctactttt | | 8365 | 8384 | 1 | 4 |
| SEQ ID NO: 3139 aaaaaatgacttccaattt | 3678 | 3697 | SEQ ID NO: 4479 aaatccaatctcctctttt | | 8406 | 8425 | 1 | 4 |
| SEQ ID NO: 3140 cagagtccctcaaacagac | 3760 | 3779 | SEQ ID NO: 4480 gtctgtgggattccatctg | | 4090 | 41.09 | 1 | 4 |
| SEQ ID NO: 3141 aaattaatagttgcaatga | 3803 | 3822 | SEQ ID NO: 4481 tcataagttcaatgaattt | | 13186 | 13205 | 1 | 4 |
| SEQ ID NO: 3142 ttcaacctccagaacatgg | 3899 | 3918 | SEQ ID NO: 4482 ccattgaccagatgctgaa | | 8142 | 8161 | 1 | 4 |
| SEQ ID NO: 3143 tgggattgccagacttcca | 3915 | 3934 | SEQ ID NO: 4483 tggaaatgggcctgcccca | | 8903 | 8922 | 1 | 4 |
| SEQ ID NO: 3144 cagtttgaaaattgagatt | 3994 | 4013 | SEQ ID NO: 4484 aatcacaactcctccactg | | 9541 | 9560 | 1 | 4 |
| SEQ ID NO: 3145 gaaaattgagattcctttg | 4000 | 4019 | SEQ ID NO: 4485 caaaactaccacacatttc | | 13694 | 13713 | 1 | 4 |
| SEQ ID NO: 3146 tttgccttttggtggcaaa | 4015 | 4034 | SEQ ID NO: 4486 tttgagaggaatcgacaaa | | 6359 | 6378 | 1 | 4 |
| SEQ ID NO: 3147 ctccagagatctaaagatg | 4036 | 4055 | SEQ ID NO: 4487 catcaattggttacaggag | | 7594 | 7613 | 1 | 4 |
| SEQ ID NO: 3148 tctaaagatgttagagact | 4045 | 4064 | SEQ ID NO: 4488 agtccttcatgtccctaga | | 10033 | 10052 | 1 | 4 |
| SEQ ID NO: 3149 ctgtgggattccatctgcc | 4092 | 4111 | SEQ ID NO: 4489 ggcattttgaaaaaaacag | | 9735 | 9754 | 1 | 4 |
| SEQ ID NO: 3150 atctgccatctcgagagtt | 4104 | 4123 | SEQ ID NO: 4490 aactctcaaaccctaagat | | 8556 | 8575 | 1 | 4 |
| SEQ ID NO: 3151 tctcgagagttccaagtcc | 4112 | 4131 | SEQ ID NO: 4491 ggacattcctctagcgaga | | 8215 | 8234 | 1 | 4 |
| SEQ ID NO: 3152 agtccctacttttaccatt | 4126 | 4145 | SEQ ID NO: 4492 aatgaatacagccaggact | | 6086 | 6105 | 1 | 4 |
| SEQ ID NO: 3153 acttttaccattcccaagt | 4133 | 4152 | SEQ ID NO: 4493 actttgtagaaatgaaagt | | 8109 | 8128 | 1 | 4 |
| SEQ ID NO: 3154 cattcccaagttgtatcaa | 4141 | 4160 | SEQ ID NO: 4494 ttgaaggacttcaggaatg | | 12009 | 12028 | 1 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3155 accacatgaaggctgactc | 4284 | 4303 | SEQ ID NO: | 4495 gagtaaaccaaaacttggt | 9024 | 9043 | 1 | 4 |
| SEQ ID NO: 3156 tttcctacaatgtgcaagg | 4317 | 4336 | SEQ ID NO: | 4496 cctttaacaattcctgaaa | 9503 | 9522 | 1 | 4 |
| SEQ ID NO: 3157 ctggagaaacaacatatga | 4338 | 4357 | SEQ ID NO: | 4497 tcattctgggtctttccag | 11035 | 11054 | 1 | 4 |
| SEQ ID NO: 3158 atcatgtgatgggtctcta | 4378 | 4397 | SEQ ID NO: | 4498 tagaattacagaaaatgat | 6565 | 6584 | 1 | 4 |
| SEQ ID NO: 3159 catgtgatgggtctctacg | 4380 | 4399 | SEQ ID NO: | 4499 cgtaggcaccgtgggcatg | 12133 | 12152 | 1 | 4 |
| SEQ ID NO: 3160 ttctagattcgaatatcaa | 4407 | 4426 | SEQ ID NO: | 4500 ttgatgatgctgtcaagaa | 7308 | 7327 | 1 | 4 |
| SEQ ID NO: 3161 tggggaccacagatgtctg | 4499 | 4518 | SEQ ID NO: | 4501 cagaattccagcttcccca | a334 | 8353 | 1 | 4 |
| SEQ ID ND: 3162 ctaacactggccggctcaa | 4644 | 4663 | SEQ ID NO: | 4502 ttgaggctattgatgttag | 6984 | 7003 | 1 | 4 |
| SEQ ID NO: 3163 taacactggccggctcaat | 4645 | 4664 | SEQ ID NO: | 4503 attgaggctattgatgtta | 6983 | 7002 | 1 | 4 |
| SEQ ID NO: 3164 aacactggccggctcaatg | 4646 | 4665 | SEQ ID NO: | 4504 cattgaggctattgatgtt | 6982 | 7001 | 1 | 4 |
| SEQ ID NO: 3165 ctggccggctcaatggaga | 4650 | 4669 | SEQ ID NO: | 4505 tctccatctgcgctaccag | 12073 | 12092 | 1 | 4 |
| SEQ ID NO: 3166 agataacaggaagatatga | 4713 | 4732 | SEQ ID NO: | 4506 tcatctcctttcttcatct | 10210 | 10229 | 1 | 4 |
| SEQ ID NO: 3167 tccctcacctccacctctg | 4745 | 4764 | SEQ ID NO: | 4507 cagatatatatctccggga | 8184 | 8203 | 1 | 4 |
| SEQ ID NO: 3168 agctgactttaaaatctga | 4818 | 4837 | SEQ ID NO: | 4508 tcaggctcttcagaaagct | 7930 | 7949 | 1 | 4 |
| SEQ ID NO: 3169 ctgactttaaaatctgaca | 4820 | 4839 | SEQ ID NO: | 4509 tgtcaagataaacaatcag | 8740 | 8759 | 1 | 4 |
| SEQ ID NO: 3170 caagatggatatgaccttc | 4873 | 4892 | SEQ ID NO: | 4510 gaagtagtcctgcatcttg | 6843 | 6862 | 1 | 4 |
| SEQ ID NO: 3171 gctgcgttctgaatatcag | 4909 | 4928 | SEQ ID NO: | 4511 ctgagtcccagtgcccagc | 9350 | 9369 | 1 | 4 |
| SEQ ID NO: 3172 cgttctgaatatcaggctg | 4913 | 4932 | SEQ ID NO: | 4512 cagcaagtacctgagaacg | 8611 | 8630 | 1 | 4 |
| SEQ ID NO: 3173 aattcccatggtcttgagt | 4976 | 4995 | SEQ ID NO: | 4513 actcagatcaaagttaatt | 12272 | 12291 | 1 | 4 |
| SEQ ID NO: 3174 tggtcttgagttaaatgct | 4984 | 5003 | SEQ ID NO: | 4514 agcacagtacgaaaaacca | 10809 | 10828 | 1 | 4 |
| SEQ ID NO: 3175 cttgagttaaatgctgaca | 4988 | 5007 | SEQ ID NO: | 4515 tgtccctagacatctcaag | 10042 | 10061 | 1 | 4 |
| SEQ ID NO: 3176 ttgagttaaatgctgacat | 4989 | 5008 | SEQ ID NO: | 4516 atgtccctagaaatctcaa | 10041 | 10060 | 1 | 4 |
| SEQ ID NO: 3177 tgagttaaatgctgacatc | 4990 | 5009 | SEQ ID NO: | 4517 gatggaaccctctccctca | 4733 | 4752 | 1 | 4 |
| SEQ ID NO: 3178 acttgaagtgtagtctcct | 5094 | 5113 | SEQ ID NO: | 4518 aggaaactcagatcaaagt | 12267 | 12286 | 1 | 4 |
| SEQ ID NO: 3179 agtgtagtctcctggtgct | 5100 | 5119 | SEQ ID NO: | 4519 agcagccagtggcaccact | 12514 | 12533 | 1 | 4 |
| SEQ ID NO: 3180 gtgctggagaatgagctga | 5114 | 5133 | SEQ ID NO: | 4520 tcagccaggtttatagcac | 7734 | 7753 | 1 | 4 |
| SEQ ID NO: 3181 ctggggcatctatgaaatt | 5151 | 5170 | SEQ ID NO: | 4521 aatttctgattaccaccag | 13579 | 13598 | 1 | 4 |
| SEQ ID NO: 3182 atggccgcttcaggdaaca | 5178 | 5197 | SEQ ID NO: | 4522 tgttttttggaaatggcat | 8649 | 8668 | 1 | 4 |
| SEQ ID NO: 3183 ttcagtctggatgggaaag | 5207 | 5226 | SEQ ID NO: | 4523 ctttgacaggcattttgaa | 9727 | 9746 | 1 | 4 |
| SEQ ID NO: 3184 ccatgattctgggtgtcga | 5265 | 5284 | SEQ ID NO: | 4524 tcgatgcacatacaaatgg | 5838 | 5857 | 1 | 4 |
| SEQ ID NO: 3185 aaaacattttcaacttcaa | 5289 | 5308 | SEQ ID NO: | 4525 ttgatgttagagtgctttt | 6993 | 7012 | 1 | 4 |
| SEQ ID NO: 3186 cttaagctctcaaatgaca | 5324 | 5343 | SEQ ID NO: | 4526 tgtcctacaacaagttaag | 7255 | 7274 | 1 | 4 |
| SEQ ID NO: 3187 ttaagctctcaaatgacat | 5325 | 5344 | SEQ ID NO: | 4527 atgtcctacaacaagttac | 7254 | 7273 | 1 | 4 |
| SEQ ID NO: 3188 catgatgggctcatatgct | 5341 | 5360 | SEQ ID NO: | 4528 agcatctttggctcacatg | 7624 | 7643 | 1 | 4 |
| SEQ ID NO: 3189 tgggctcatatgctgaaat | 5346 | 5365 | SEQ ID NO: | 4529 atttatcaaaagaagccca | 12942 | 12961 | 1 | 4 |
| SEQ ID NO: 3190 actggacttctcttcaaaa | 5407 | 5426 | SEQ ID NO: | 4530 ttttggcaagctatacagt | 8380 | 8399 | 1 | 4 |
| SEQ ID NO: 3191 acttctcttcaaaacttga | 5412 | 5431 | SEQ ID NO: | 4531 tcaattgggagagacaagt | 6504 | 6523 | 1 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3192 ctgacaagtttttataagca | 5445 | 5464 | SEQ ID NO: 4532 tgctttgtgagtttatcag | | 9693 | 9712 | 1 | 4 |
| SEQ ID NO: 3193 aagttttataagcaaactg | 5450 | 5469 | SEQ ID NO: 4533 cagtcatgtagaaaaactt | | 4429 | 4448 | 1 | 4 |
| SEQ ID NO: 3194 ctgttaatttacagctaca | 5466 | 5485 | SEQ ID NO: 4534 tgtactggaaaacgtacag | | 6388 | 6407 | 1 | 4 |
| SEQ ID NO: 3195 ttacagctacagccctatt | 5474 | 5493 | SEQ ID NO: 4535 aatattgatcaatttgtaa | | 6425 | 6444 | 1 | 4 |
| SEQ ID NO: 3196 tctggtaactactttaaac | 5494 | 5513 | SEQ ID NO: 4536 gtttgaaaaacaaagcaga | | 11820 | 11839 | 1 | 4 |
| SEQ ID NO: 3197 ttttaaacagtgacctgaaa | 5505 | 5525 | SEQ ID NO: 4537 tttcatttgaaagaataaa | | 7032 | 7051 | 1 | 4 |
| SEQ ID NO: 3198 ttaaacagtgacctgaaat | 5507 | 5526 | SEQ ID NO: 4538 atttcaagcaagaacttaa | | 10434 | 10453 | 1 | 4 |
| SEQ ID NO: 3199 cagtgacctgaaatacaat | 5512 | 5531 | SEQ ID NO: 4539 attggcgtggagcttactg | | 6131 | 6150 | 1 | 4 |
| SEQ ID NO: 3200 tgtggctggtaacctaaaa | 5584 | 5603 | SEQ ID NO: 4540 ttttgctggagaagccaca | | 10765 | 10784 | 1 | 4 |
| SEQ ID NO: 3201 ttatcagcaagctataaag | 5657 | 5676 | SEQ ID NO: 4541 ctttgcactatgttcataa | | 12764 | 12783 | 1 | 4 |
| SEQ ID NO: 3202 ggttcagggtgtggagttt | 5692 | 5711 | SEQ ID NO: 4542 aaacacctaagagtaaacc | | 9014 | 9033 | 1 | 4 |
| SEQ ID NO: 3203 attcagactcactgcattt | 5775 | 5794 | SEQ ID NO: 4543 aaatgctgacatagggaat | | 8437 | 8456 | 1 | 4 |
| SEQ ID NO: 3204 ttcagactcactgcatttc | 5776 | 5795 | SEQ ID NO: 4544 gaaatattatgaacttgaa | | 13312 | 13331 | 1 | 4 |
| SEQ ID NO: 3205 tacaaatggcaatgggaaa | 5848 | 5867 | SEQ ID NO: 4545 tttcctaaagctggatgta | | 11176 | 11195 | 1 | 4 |
| SEQ ID NO: 3206 gctgtatagcaaattcctg | 5896 | 5915 | SEQ ID NO: 4546 caggtccatgcaagtcagc | | 10919 | 10938 | 1 | 4 |
| SEQ ID NO: 3207 tgagcagacaggcacctgg | 6043 | 6062 | SEQ ID NO: 4547 ccagcttccccacatctca | | 8341 | 8360 | 1 | 4 |
| SEQ ID NO: 3208 ggcacctggaaaactcaaga | 6053 | 6072 | SEQ ID NO: 4548 tcttcgtgtttcaactgcc | | 11221 | 11240 | 1 | 4 |
| SEQ ID NO: 3209 tgaatacagccaggacttg | 6088 | 6107 | SEQ ID NO: 4549 caagtaagtgctaggttca | | 9380 | 9399 | 1 | 4 |
| SEQ ID NO: 3210 gaatacagccaggacttgg | 6089 | 6108 | SEQ ID NO: 4550 ccaacacttacttgaattc | | 10668 | 10687 | 1 | 4 |
| SEQ ID NO: 3211 ctggacgaactctggctga | 6147 | 6166 | SEQ ID NO: 4551 tcagaaagctaccttccag | | 7939 | 7958 | 1 | 4 |
| SEQ ID NO: 3212 tttttactcagtgagcccat | 6201 | 6220 | SEQ ID NO: 4552 atggacttcttctggaaaa | | 8878 | 8897 | 1 | 4 |
| SEQ ID NO: 3213 gatgagagatgccgttgag | 6241 | 6260 | SEQ ID NO: 4553 ctcatctcctttcttcatc | | 10209 | 10228 | 1 | 4 |
| SEQ ID NO: 3214 aattgttgcttttgtaaag | 6277 | 6296 | SEQ ID NO: 4554 cttttctaaacttgaaatt | | 9064 | 9083 | 1 | 4 |
| SEQ ID NO: 3215 cttttgtaaagtatgataa | 6285 | 6304 | SEQ ID NO: 4555 ttatgaacttgaagaaaag | | 13318 | 13337 | 1 | 4 |
| SEQ ID NO: 3216 tttgtaaagtatgataaaa | 6287 | 6306 | SEQ ID NO: 4556 ttttcacattagatgcaaa | | 8421 | 8440 | 1 | 4 |
| SEQ ID NO: 3217 tccattaacctcccatttt | 6320 | 6339 | SEQ ID NO: 4557 aaaattgatgatatctgga | | 10727 | 10746 | 1 | 4 |
| SEQ ID NO: 3218 ccattaacctcccattttt | 6321 | 6340 | SEQ ID NO: 4558 aaaagggtcatggaaatgg | | 8893 | 8912 | 1 | 4 |
| SEQ ID NO: 3219 cttgcaagaatatttgag | 6346 | 6365 | SEQ ID NO: 4559 ctcaattttgattttcaag | | 8528 | 8547 | 1 | 4 |
| SEQ ID NO: 3220 agaatatttgagaggaat | 6352 | 6371 | SEQ ID NO: 4560 attccctccattaagttct | | 11708 | 11727 | 1 | 4 |
| SEQ ID NO: 3221 attatagttgtactggaaa | 6380 | 6399 | SEQ ID NO: 4561 tttcaagcaagaacttaat | | 10435 | 10454 | 1 | 4 |
| SEQ ID NO: 3222 gaagcacatcaatattgat | 6415 | 6434 | SEQ ID NO: 4562 atcagttcagataaacttc | | 7999 | 8018 | 1 | 4 |
| SEQ ID NO: 3223 acatcaatattgatcaatt | 6420 | 6439 | SEQ ID NO: 4563 aattccctgaagttgatgt | | 11487 | 11506 | 1 | 4 |
| SEQ ID NO: 3224 gaaaactcccacagcaagc | 6465 | 6484 | SEQ ID NO: 4564 gctttctcttccacatttc | | 10060 | 10079 | 1 | 4 |
| SEQ ID NO: 3225 ctgaattcattcaattggg | 6494 | 6513 | SEQ ID NO: 4565 cccatttacagatcttcag | | 11371 | 11390 | 1 | 4 |
| SEQ ID NO: 3226 tgaattcattcaattggga | 6495 | 6514 | SEQ ID NO: 4566 tcccatttacagatcttca | | 11370 | 11389 | 1 | 4 |
| SEQ ID NO: 3227 aactgactgctctcacaaa | 6540 | 6559 | SEQ ID NO: 4567 tttgaggattccatcagtt | | 7987 | 8006 | 1 | 4 |
| SEQ ID NO: 3228 acaagtatagaattacagc | 6558 | 6577 | SEQ ID NO: 4568 tctggctccctcaactttt | | 9050 | 9069 | 1 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3229 atcaactttaatgaaaaac | 6611 | 6630 | SEQ ID NO: | 4569 gtttattgaaaatattgat | 6811 | 6830 | 1 | 4 |
| SEQ ID NO: 3230 tgatttgaaaatagctatt | 6694 | 6713 | SEQ ID NO: | 4570 aatattattgatgaaatca | 6716 | 6735 | 1 | 4 |
| SEQ ID NO: 3231 atttgaaaatagctattgc | 6696 | 6715 | SEQ ID NO: | 4571 gcaagaacttaatggaaat | 10441 | 10460 | 1 | 4 |
| SEQ ID NO: 3232 attgctaatattattgatg | 6710 | 6729 | SEQ ID NO: | 4572 catcacactgaataccaat | 10159 | 10178 | 1 | 4 |
| SEQ ID NO: 3233 gaaaaattaaaaagtcttg | 6737 | 6756 | SEQ ID NO: | 4573 caagagcttatgggatttc | 11161 | 11180 | 1 | 4 |
| SEQ ID NO: 3234 actatcatatccgtgtaat | 6762 | 6781 | SEQ ID NO: | 4574 attactttgagaaattagt | 7281 | 7300 | 1 | 4 |
| SEQ ID NO: 3235 tattgattttaacaaaagt | 6823 | 6842 | SEQ ID NO: | 4575 acttgacttcagagaaata | 11404 | 11423 | 1 | 4 |
| SEQ ID NO: 3236 ctgcagcagcttaagagac | 6914 | 6933 | SEQ ID NO: | 4576 gtcttcagtgaagctgcag | 10599 | 10718 | 1 | 4 |
| SEQ ID NO: 3237 aaaacaacacattgaggct | 6973 | 6992 | SEQ ID NO: | 4577 agcctcacctcttacttttt | 10571 | 10590 | 1 | 4 |
| SEQ ID NO: 3238 ttgagcatgtcaaacactt | 7059 | 7078 | SEQ ID NO: | 4578 aagtagctgagaaaatcaa | 7104 | 7123 | 1 | 4 |
| SEQ ID NO: 3239 tttgaagtagctgagaaaa | 7100 | 7119 | SEQ ID NO: | 4579 ttttcacattagatgcaaa | 8421 | 8440 | 1 | 4 |
| SEQ ID NO: 3240 ttagtagagttggcccacc | 7199 | 7218 | SEQ ID NO: | 4580 ggtggactcttgctgctaa | 7776 | 7795 | 1 | 4 |
| SEQ ID NO: 3241 tgaaggagactattcagaa | 7227 | 7246 | SEQ ID NO: | 4581 ttctcaattttgattttca | 8526 | 6545 | 1 | 4 |
| SEQ ID NO: 3242 gagactattcagcagctaa | 7232 | 7251 | SEQ ID NO: | 4582 ttagccacagctctgtctc | 10301 | 10320 | 1 | 4 |
| SEQ ID NO: 3243 aattagttggatttattga | 7293 | 7312 | SEQ ID NO: | 4583 tcaagaagcttaatgaatt | 7320 | 7339 | 1 | 4 |
| SEQ ID NO: 3244 gcttaatgaattatctttt | 7327 | 7346 | SEQ ID NO: | 4584 aaaacgagcttcaggacgc | 13209 | 13228 | 1 | 4 |
| SEQ ID NO: 3245 ttaacaaattccttgacat | 7365 | 7384 | SEQ ID NO: | 4585 atgtcctacaacaagttaa | 7254 | 7273 | 1 | 4 |
| SEQ ID NO: 3246 aaattaaagtcatttgatt | 7394 | 7413 | SEQ ID NO: | 4586 aatcctttgacaggcattt | 9723 | 9742 | 1 | 4 |
| SEQ ID NO: 3247 gactcaatggtgaaattca | 7464 | 7483 | SEQ ID NO: | 4587 tgaaattcaatcacaagtc | 9076 | 9095 | 1 | 4 |
| SEQ ID NO: 3248 gaaattcaggctctggaac | 7475 | 7494 | SEQ ID NO: | 4588 gttctcaattttgattttc | 8525 | 8544 | 1 | 4 |
| SEQ ID NO: 3249 actaccacaaaaagctgaa | 7492 | 7511 | SEQ ID NO: | 4589 ttcaggaactattgctagt | 10645 | 10664 | 1 | 4 |
| SEQ ID NO: 3250 ccaaaataaccttaatcat | 7578 | 7597 | SEQ ID NO: | 4590 atgattccctgaccttgg | 10950 | 10969 | 1 | 4 |
| SEQ ID NO: 3251 aaataaccttaatcatcaa | 7581 | 7600 | SEQ ID NO: | 4591 ttgaagtaaaagaaaattt | 10749 | 10768 | 1 | 4 |
| SEQ ID NO: 3252 tttaagttcagcatctttg | 7615 | 7634 | SEQ ID NO: | 4592 caaatctggatttcttaaa | 9480 | 9499 | 1 | 4 |
| SEQ ID NO: 3253 caggtttatagcacacttg | 7739 | 7758 | SEQ ID NO: | 4593 caagggttcactgttcctg | 7865 | 7884 | 1 | 4 |
| SEQ ID NO: 3254 gttcactgttcctgaaatc | 7870 | 7889 | SEQ ID NO: | 4594 gattctcagatgagggaac | 8922 | 8941 | 1 | 4 |
| SEQ ID NO: 3255 cactgttcctgaaatcaag | 7873 | 7892 | SEQ ID NO: | 4595 cttgaacacaaagtcagtg | 6008 | 6027 | 1 | 4 |
| SEQ ID NO: 3256 actgttcctgaaatcaaga | 7874 | 7893 | SEQ ID NO: | 4596 tcttgaacacaaagtcagt | 6007 | 6026 | 1 | 4 |
| SEQ ID NO: 3257 gcctgcctttgaagtcagt | 7909 | 7928 | SEQ ID NO: | 4597 actgttgactcaggaaggc | 12580 | 12599 | 1 | 4 |
| SEQ ID NO: 3258 taacagatttgaggattcc | 7980 | 7999 | SEQ ID NO: | 4598 ggaagcttctcaagagtta | 13222 | 13241 | 1 | 4 |
| SEQ ID NO: 3259 gttttccacaccagaatttt | 8050 | 8069 | SEQ ID NO: | 4599 aaatttctctgctggaaac | 9418 | 9437 | 1 | 4 |
| SEQ ID NO: 3260 tcagaaccattgaccagat | 8136 | 8155 | SEQ ID NO: | 4600 atctgcagaacaatgctga | 12438 | 12457 | 1 | 4 |
| SEQ ID NO: 3261 tagcgagaatcaccctgcc | 8226 | 8245 | SEQ ID NO: | 4601 ggcagcttctggcttgcta | 12301 | 12320 | 1 | 4 |
| SEQ ID NO: 3262 ccttaatgattttcaagtt | 8299 | 8318 | SEQ ID NO: | 4602 aactgttgactcaggaagg | 12579 | 12598 | 1 | 4 |
| SEQ ID NO: 3283 acataccagaattccgct | 8328 | 8347 | SEQ ID NO: | 4603 agctgccagtccttcatgt | 10026 | 10045 | 1 | 4 |
| SEQ ID NO: 3284 aatgctgacatagggaatg | 8438 | 8457 | SEQ ID NO: | 4604 cattaatcctgccatcatt | 10005 | 10024 | 1 | 4 |
| SEQ ID NO: 3265 atgctgacatagggaatgg | 8439 | 8458 | SEQ ID NO: | 4605 ccatttgagatcacggcat | 9245 | 9264 | 1 | 4 |

TABLE 9-continued

Selected palindromic sequences from human ApoB

| Source | Start Index | End Index | Match | Start Index | End # | B | |
|---|---|---|---|---|---|---|---|
| SEQ ID NO: 3266aaccacctcagcaaacgaa | 8458 | 8477 | SEQ ID NO: 4608ttcgttttccattaaggtt | 9291 | 9310 | 1 | 4 |
| SEQ ID NO: 3267agcaggtatcgcagcttcc | 8476 | 8495 | SEQ ID NO: 4607ggaagtggccctgcatgct | 10972 | 10991 | 1 | 4 |
| SEQ ID NO: 3268tgcacaactctcaaaccct | 8551 | 8570 | SEQ ID NO: 4608agggaaagagaagattgca | 13501 | 13520 | 1 | 4 |
| SEQ ID NO: 3269aggagtcagtgaagttctc | 8592 | 8611 | SEQ ID NO: 4609gagaacttactatcatcct | 13788 | 13807 | 1 | 4 |
| SEQ ID NO: 3270tttttggaaatgccattga | 8652 | 8671 | SEQ ID NO: 4610tcaatgaatttattcaaaa | 13194 | 13213 | 1 | 4 |
| SEQ ID NO: 3271aatggagtgattgtcaaga | 8729 | 8748 | SEQ ID NO: 4611tcttttcagcccagccatt | 9231 | 9250 | 1 | 4 |
| SEQ ID NO: 3272gtcaagataaacaatcagc | 8741 | 8760 | SEQ ID NO: 4612gctgactttaaaatctgac | 4819 | 4838 | 1 | 4 |
| SEQ ID NO: 3273tccacaaattgaacatccc | 8787 | 8806 | SEQ ID NO: 4613gggatttcctaaagctgga | 11172 | 11191 | 1 | 4 |
| SEQ ID NO: 3274ttgaacatccccaaactgg | 8795 | 8814 | SEQ ID NO: 4614ccagtttccagggactcaa | 12603 | 12622 | 1 | 4 |
| SEQ ID NO: 3275acatccccaaactggactt | 8799 | 8818 | SEQ ID NO: 4615aagtcgattcccagcatgt | 9090 | 9109 | 1 | 4 |
| SEQ ID NO: 3276acttctctagtcaggctga | 8814 | 8833 | SEQ ID NO: 4616tcagatggaaaaatgaagt | 11010 | 11029 | 1 | 4 |
| SEQ ID NO: 3277tgaatcacaaattagtttc | 8944 | 8963 | SEQ ID NO: 4617gaaagtccataatggttca | 12817 | 12836 | 1 | 4 |
| SEQ ID NO: 3278agaaggaccccctcacttcc | 8968 | 8987 | SEQ ID NO: 4618ggaagaagaggcagcttct | 12292 | 12311 | 1 | 4 |
| SEQ ID NO: 3279ttggactgtccaataagat | 8988 | 9007 | SEQ ID NO: 4619atctaaatgcagtagccaa | 11634 | 11653 | 1 | 4 |
| SEQ ID NO: 3280actgtccaataagatcaat | 8992 | 9011 | SEQ ID NO: 4620attgataaaaccatacagt | 13891 | 13910 | 1 | 4 |
| SEQ ID NO: 3281ctgtccaataagatcaata | 8993 | 9012 | SEQ ID NO: 4621tattgataaaaccatacag | 13890 | 13909 | 1 | 4 |
| SEQ ID NO: 3262gtttatgaatctggctccc | 9041 | 9060 | SEQ ID NO: 4622gggaatctgatgaggaaac | 12255 | 12274 | 1 | 4 |
| SEQ ID NO: 3283atgaatctggctccctcaa | 9045 | 9064 | SEQ ID NO: 4623ttgagttgcccaccatcat | 11667 | 11686 | 1 | 4 |
| SEQ ID NO: 3284ctcaacttttctaaacttg | 9059 | 9078 | SEQ ID NO: 4624caagatcgcagactttgag | 11653 | 11672 | 1 | 4 |
| SEQ ID NO: 3285ctaaaggcatggcactgtt | 9129 | 9148 | SEQ ID NO: 4625aacagaaacaatgcattag | 9749 | 9768 | 1 | 4 |
| SEQ ID NO: 3286aaggcatggcactgtttgg | 9132 | 9151 | SEQ ID NO: 4626ccaagaaaaggcacacctt | 11077 | 11096 | 1 | 4 |
| SEQ ID NO: 3287atccacaaacaatgaaggg | 9262 | 9281 | SEQ ID NO: 4627ccctaacagatttgaggat | 7977 | 7996 | 1 | 4 |
| SEQ ID NO: 3288ggaatttgaaagttcgttt | 9279 | 9298 | SEQ ID NO: 4628aaacaaacacaggcattcc | 9655 | 9674 | 1 | 4 |
| SEQ ID NO: 3289aataactatgcactgtttc | 9332 | 9351 | SEQ ID NO: 4629gaaatactgttttcctatt | 12836 | 12855 | 1 | 4 |
| SEQ ID NO: 3290gaaacaacgagaacattat | 9432 | 9451 | SEQ ID NO: 4630ataaactgcaagattttc | 13608 | 13627 | 1 | 4 |
| SEQ ID NO: 3291ttccttgaaaacgacaaagc | 9599 | 9618 | SEQ ID NO: 4631gctttccaatgaccaagaa | 11085 | 11084 | 1 | 4 |
| SEQ ID NO: 3292ataagaaaaacaaacacag | 9648 | 9667 | SEQ ID NO: 4632ctgtgctttgtgagtttat | 9690 | 9709 | 1 | 4 |
| SEQ ID NO: 3293aaaacaaacacaggcattc | 9654 | 9673 | SEQ ID NO: 4633gaatttgaaagttcgtttt | 9280 | 9299 | 1 | 4 |
| SEQ ID NO: 3294gcattccatcacaaatcct | 9667 | 9686 | SEQ ID NO: 4634aggaagtggccctgaatgc | 10971 | 10990 | 1 | 4 |
| SEQ ID NO: 3295tttgaaaaaaacagaaaca | 9740 | 9759 | SEQ ID NO: 4635tgttgaaagatttatcaaa | 12933 | 12952 | 1 | 4 |
| SEQ ID NO: 3296caatgcattagattttgtc | 9757 | 9776 | SEQ ID NO: 4636gacaagaaaaagggattg | 10279 | 10298 | 1 | 4 |
| SEQ ID NO: 3297caaagctgaaaaatctcag | 9817 | 9836 | SEQ ID NO: 4637ctgagaacttcatcatttg | 11438 | 11457 | 1 | 4 |
| SEQ ID NO: 3298cctggatacactgttccag | 9863 | 9882 | SEQ ID NO: 4638ctggacttctctagtcagg | 8810 | 8829 | 1 | 4 |
| SEQ ID NO: 3299gttgaagtgtctccattca | 9890 | 9909 | SEQ ID NO: 4639tgaatctggctccctcaac | 9046 | 9065 | 1 | 4 |
| SEQ ID NO: 3300tttctccatcctaggttct | 9964 | 9983 | SEQ ID NO: 4640agaatccagatacaagaaa | 6893 | 6912 | 1 | 4 |
| SEQ ID NO: 3301ttctccatcctaggttctg | 9965 | 9984 | SEQ ID NO: 4641cagaatccagatacaagaa | 6892 | 6911 | 1 | 4 |
| SEQ ID NO: 3302tcattagagctgccagtcc | 10019 | 10038 | SEQ ID NO: 4642ggacagtgaaatattatga | 13305 | 13324 | 1 | 4 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3303 tgctgaactttttaaccag | 10177 | 10196 | SEQ ID NO: 4643 ctggatgtaaccaccagca | | 11186 | 11205 | 1 | 4 |
| SEQ ID NO: 3304 ctcctttcttcatcttcgt | 10214 | 10233 | SEQ ID NO: 4644 atgaagcttgctccaggag | | 13772 | 13791 | 1 | 4 |
| SEQ ID NO: 3305 tgtcattgatgcactgcag | 10234 | 10253 | SEQ ID NO: 4645 ctgcgctaccagaaagaca | | 12080 | 12099 | 1 | 4 |
| SEQ ID NO: 3306 tgatgcactgcagtacaaa | 10240 | 10259 | SEQ ID NO: 4646 tttgagttgcccaccatca | | 11666 | 11685 | 1 | 4 |
| SEQ ID NO: 3307 agctctgtctctgagcaac | 10309 | 10328 | SEQ ID NO: 4647 gttgaccacaagcttagct | | 10547 | 10566 | 1 | 4 |
| SEQ ID NO: 3308 agccgaaattccaattttg | 10408 | 10427 | SEQ ID ND: 4648 caaagctggcaccagggct | | 13971 | 13990 | 1 | 4 |
| SEQ ID NO: 3309 ttgagaatgaatttcaagc | 10424 | 10443 | SEQ ID NO: 4649 gcttcaggaagcttctcaa | | 13216 | 13235 | 1 | 4 |
| SEQ ID NO: 3310 aaacctactgtctcttcct | 10469 | 10488 | SEQ ID NO: 4650 aggaaggccaagccagttt | | 12591 | 12610 | 1 | 4 |
| SEQ ID NO: 3311 tacttttccattgagtcat | 10583 | 10602 | SEQ ID NO: 4651 atgattatgtcaacaagta | | 12363 | 12382 | 1 | 4 |
| SEQ ID NO: 3312 tcaggtccctgcaagtcag | 10918 | 10937 | SEQ ID NO: 4652 ctgacatcttaggcactga | | 5001 | 6020 | 1 | 4 |
| SEQ ID NO: 3313 atgcaagtcagcccagttc | 10926 | 10945 | SEQ ID NO: 4653 gaactcagaaggatggcat | | 14002 | 14021 | 1 | 4 |
| SEQ ID NO: 3314 tgaatgctaacactaagaa | 10983 | 11002 | SEQ ID NO: 4654 ttctcaattttgattttca | | 8526 | 8545 | 1 | 4 |
| SEQ ID NO: 3315 agaagatcagatggaaaaa | 11004 | 11023 | SEQ ID NO: 4655 ttttctaaatggaacttct | | 12173 | 12192 | 1 | 4 |
| SEQ ID NO: 3316 ggctattcattctccatcc | 11264 | 11283 | SEQ ID NO: 4656 ggatctaaatgcagtagcc | | 11632 | 11651 | 1 | 4 |
| SEQ ID NO: 3317 aaagttttggctgataaat | 11288 | 11307 | SEQ ID NO: 4657 atttcttaaacattccttt | | 9489 | 9508 | 1 | 4 |
| SEQ ID NO: 3318 agttttggctgataaattc | 11290 | 11309 | SEQ ID NO: 4658 gaatctggctccctcaact | | 9047 | 9086 | 1 | 4 |
| SEQ ID NO: 3319 ctgggctgaaactaaatga | 11316 | 11335 | SEQ ID NO: 4659 tcattctgggtcttttccag | | 11035 | 11054 | 1 | 4 |
| SEQ ID NO: 3320 cagagaaatacaaatctat | 11413 | 11432 | SEQ ID NO: 4660 atagcatggacttcttctg | | 8873 | 8892 | 1 | 4 |
| SEQ ID NO: 3321 gaggtaaaattccctgaag | 11480 | 11499 | SEQ ID NO: 4662 cttctggcttgctaacctc | | 12306 | 12325 | 1 | 4 |
| SEQ ID NO: 3322 ctttttttgagataaccgtg | 11545 | 11564 | SEQ ID NO: 4663 cacggagttactgaaaaag | | 13723 | 13742 | 1 | 4 |
| SEQ ID NO: 3323 gctggaattgtcattcctt | 11735 | 11754 | SEQ ID NO: 4664 aaggcatctccacctcagc | | 12102 | 12121 | 1 | 4 |
| SEQ ID NO: 3324 gtgtataatgccacttgga | 11795 | 11814 | SEQ ID NO: 4665 tccaagatgagatcaacac | | 13104 | 13123 | 1 | 4 |
| SEQ ID NO: 3325 attccacatgcagctcaac | 11859 | 11878 | SEQ ID NO: 4666 gttgagaagccccaagaat | | 6254 | 6273 | 1 | 4 |
| SEQ ID NO: 3326 tgaagaagatggcaaattt | 11992 | 12011 | SEQ ID NO: 4667 aaattctcttttcttttca | | 9220 | 9239 | 1 | 4 |
| SEQ ID NO: 3327 atcaaaagcccagcgttca | 12050 | 12069 | SEQ ID NO: 4668 tgaaagtcaagcatctgat | | 12669 | 12688 | 1 | 4 |
| SEQ ID NO: 3328 gtgggcatggatatggatg | 12143 | 12162 | SEQ ID NO: 4669 catccttaacaccttccac | | 8071 | 8090 | 1 | 4 |
| SEQ ID NO: 3329 aaatggaacttctactaca | 12179 | 12198 | SEQ ID NO: 4670 tgtaccataagccatattt | | 10088 | 10107 | 1 | 4 |
| SEQ ID NO: 3330 aaaaactcaccatattcaa | 12219 | 12238 | SEQ ID NO: 4671 ttgatgttagagtgctttt | | 6993 | 7012 | 1 | 4 |
| SEQ ID NO: 3331 ctgagaagaaatctgcaga | 12428 | 12447 | SEQ ID NO: 4672 tctgcccagaaatattcag | | 13447 | 13466 | 1 | 4 |
| SEQ ID NO: 3332 acaatgctgagtgggttta | 12447 | 12466 | SEQ ID NO: 4673 taaatggagtctttattgt | | 14086 | 14105 | 1 | 4 |
| SEQ ID NO: 3333 caatgctgagtgggtttat | 12448 | 12467 | SEQ ID NO: 4674 ataaatggagtctttattg | | 14085 | 14104 | 1 | 4 |
| SEQ ID NO: 3334 ttaggcaaattgatgatat | 12477 | 12496 | SEQ ID NO: 4675 atattgtcagtgcctctaa | | 13392 | 13411 | 1 | 4 |
| SEQ ID NO: 3335 ataaactaatagatgtaat | 12897 | 12916 | SEQ ID NO: 4676 attactatgaaaaattat | | 13641 | 13660 | 1 | 4 |
| SEQ ID NO: 3336 ccaactaatagaagataac | 13039 | 13058 | SEQ ID NO: 4677 gttattttgctaaacttgg | | 14052 | 14071 | 1 | 4 |
| SEQ ID NO: 3337 ttaattatatccaagatga | 13095 | 13114 | SEQ ID NO: 4678 tcatcctctaattttttaa | | 13800 | 13819 | 1 | 4 |
| SEQ ID NO: 3338 tttaaattgttgaaagaaa | 13151 | 13170 | SEQ ID NO: 4679 tttcatttgaaagaataaa | | 7032 | 7051 | 1 | 4 |
| SEQ ID NO: 3339 aagttcaatgaatttattc | 13190 | 13209 | SEQ ID NO: 4680 gaataccaatgctgaactt | | 10168 | 10187 | 1 | 4 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3340 ttgaagaaaagatagtccg | 13326 | 13345 | SEQ ID NO: | 4681 ctgagagaagtgtcttcaa | 12407 | 12426 | 1 | 4 |
| SEQ ID NO: 3341 acttccattctgaatatat | 13377 | 13396 | SEQ ID NO: | 4682 atatctggaaccttgaagt | 10737 | 10756 | 1 | 4 |
| SEQ ID NO: 3342 cacagaaatattcaggaat | 13451 | 13470 | SEQ ID NO: | 4683 attccctgaagttgatgtg | 11488 | 11507 | 1 | 4 |
| SEQ ID NO: 3343 ccattgcgacgaagaaaat | 13560 | 13579 | SEQ ID NO: | 4684 attttttattcctgccatgg | 10103 | 10122 | 1 | 4 |
| SEQ ID NO: 3344 tataaactgcaagatttt | 13607 | 13626 | SEQ ID NO: | 4685 aaaattcaaactgcctata | 13873 | 13892 | 1 | 4 |
| SEQ ID NO: 3345 tctgattactatgaaaaat | 13637 | 13656 | SEQ ID NO: | 4686 atttgtaagaaaatacaga | 6436 | 6455 | 1 | 4 |
| SEQ ID NO: 3346 ggagttactgaaaaagctg | 13726 | 13745 | SEQ ID NO: | 4687 cagcatgcctagtttctcc | 9952 | 9971 | 1 | 4 |
| SEQ ID NO: 3347 tgaagcttgctccaggaga | 13773 | 13792 | SEQ ID NO: | 4688 tctcctttcttcatcttca | 10213 | 10232 | 1 | 4 |
| SEQ ID NO: 3348 tgaactggacctgcaccaa | 13955 | 13974 | SEQ ID NO: | 4689 ttggtcgagcaagggttca | 7856 | 7875 | 1 | 4 |
| SEQ ID NO: 3349 ttgctaaacttgggggagg | 14058 | 14077 | SEQ ID NO: | 4690 cctcctacagtggtggcaa | 4230 | 4249 | 1 | 4 |
| SEQ ID NO: 3350 gattcgaatatcaaattca | 4412 | 4431 | SEQ ID NO: | 4691 tgaaaacgacaaagcaatc | 9603 | 8622 | 3 | 3 |
| SEQ ID NO: 3351 atttgtttgtcaaagaagt | 4551 | 4570 | SEQ ID NO: | 4692 acttttctaaacttgaaat | 9063 | 9082 | 3 | 3 |
| SEQ ID NO: 3352 tctcggttgctgccgctga | 33 | 52 | SEQ ID NO: | 4693 tcagcccagccatttgaga | 9236 | 9255 | 2 | 3 |
| SEQ ID NO: 3353 gctgaggagcccgcccagc | 47 | 66 | SEQ ID NO: | 4694 gctggatgtaaccaccagc | 11185 | 11204 | 2 | 3 |
| SEQ ID NO: 3354 ctggtctgtccaaaagatg | 227 | 246 | SEQ ID NO: | 4695 catcagaaccattgaccag | 8134 | 8153 | 2 | 3 |
| SEQ ID NO: 3355 ctgagagttccagtggagt | 291 | 310 | SEQ ID NO: | 4696 actcaatggtgaaattcag | 7465 | 7484 | 2 | 3 |
| SEQ ID NO: 3356 cagtgcaccctgaaagagg | 404 | 423 | SEQ ID NO: | 4697 cctcacttcctttggactg | 8977 | 8996 | 2 | 3 |
| SEQ ID NO: 3357 ctctgaggagtttgctgca | 472 | 491 | SEQ ID NO: | 4698 tgcaaacttgacttcagag | 11399 | 11418 | 2 | 3 |
| SEQ ID NO: 3358 acatcaagagggcatcat | 582 | 601 | SEQ ID NO: | 4699 atgacgttcttgagcatgt | 7050 | 7089 | 2 | 3 |
| SEQ ID NO: 3359 ctgatcagcagcagccagt | 830 | 849 | SEQ ID NO: | 4700 actggacttctctagtcag | 8809 | 8828 | 2 | 3 |
| SEQ ID NO: 3360 ggacgctaagaggaagcat | 865 | 884 | SEQ ID NO: | 4701 atgcctacgttccatgtcc | 11354 | 11373 | 2 | 3 |
| SEQ ID NO: 3361 agctgttttgaagactctc | 1087 | 1106 | SEQ ID NO: | 4702 gagaagtgtcttcaaagct | 12411 | 12430 | 2 | 3 |
| SEQ ID NO: 3362 tgaaaaaactaaccatctc | 1113 | 1132 | SEQ ID NO: | 4703 gagatcaacacaatcttca | 13112 | 13131 | 2 | 3 |
| SEQ ID NO: 3363 ctgagctgagaggcctcag | 1176 | 1195 | SEQ ID NO: | 4704 ctgaattactgcacctcag | 3035 | 3054 | 2 | 3 |
| SEQ ID NO: 3364 tgaaacgtgtgcatgccaa | 1311 | 1330 | SEQ ID NO: | 4705 ttggtagagcaagggttca | 7856 | 7875 | 2 | 3 |
| SEQ ID NO: 3365 ccttgtatgcgctgagcca | 1440 | 1459 | SEQ ID NO: | 4706 tggcactgtttggagaagg | 9138 | 9157 | 2 | 3 |
| SEQ ID NO: 3366 aggagctgctggacattgc | 1500 | 1519 | SEQ ID NO: | 4707 gcaagtcagcccagttcct | 10928 | 10947 | 2 | 3 |
| SEQ ID NO: 3367 atttgattctgcgggtcat | 1575 | 1594 | SEQ ID NO: | 4708 atgaaaccaatgacaaaat | 7428 | 7447 | 2 | 3 |
| SEQ ID NO: 3368 tccagaactcaagtcttca | 1627 | 1646 | SEQ ID NO: | 4709 tgaaatacaatgctctgga | 5520 | 5539 | 2 | 3 |
| SEQ ID NO: 3369 ggttcttcttcagactttc | 1744 | 1763 | SEQ ID NO: | 4710 gaaataccaagtcaaaacc | 10455 | 10474 | 2 | 3 |
| SEQ ID NO: 3370 gttgatgaggagtccttca | 1810 | 1829 | SEQ ID NO: | 4711 tgaaaagctgcaatcaac | 13734 | 13753 | 2 | 3 |
| SEQ ID NO: 3371 tccaagatctgaaaaagtt | 1941 | 1960 | SEQ ID NO: | 4712 aactgcttctccaaatgga | 3552 | 3571 | 2 | 3 |
| SEQ ID NO: 3372 agttagtgaaagaagttct | 1956 | 1975 | SEQ ID NO: | 4713 agaattcataatcccaact | 8275 | 8294 | 2 | 3 |
| SEQ ID NO: 3373 gaagggaatcttatatttg | 2084 | 2103 | SEQ ID NO: | 4714 caaaacctactgtctcttc | 10467 | 10488 | 2 | 3 |
| SEQ ID NO: 3374 ggaagctcttttttgggaag | 2221 | 2240 | SEQ ID NO: | 4715 cttcacataccagaattcc | 8324 | 8343 | 2 | 3 |
| SEQ ID NO: 3375 tggaataatgctcagtgtt | 2374 | 2393 | SEQ ID NO: | 4716 aacaaacacaggcattcca | 9656 | 9675 | 2 | 3 |
| SEQ ID NO: 3376 gatttgaaatccaaagaag | 2408 | 2427 | SEQ ID NO: | 4717 cttcatgtccctagaaatc | 10037 | 10056 | 2 | 3 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3377 tccaaagaagtcccggaag | 2417 | 2436 | SEQ ID NO: | 4118 cttcagcctgctttctgga | 4951 | 4970 | 2 | 3 |
| SEQ ID NO: 3378 aggaagggctcaaagaatg | 2570 | 2589 | SEQ ID NO: | 4719 cattagagctgccagtcct | 10020 | 10039 | 2 | 3 |
| SEQ ID NO: 3379 agaatgacttttttcttca | 2583 | 2602 | SEQ ID NO: | 4720 tgaagatgacgacttttct | 12160 | 12179 | 2 | 3 |
| SEQ ID NO: 3380 tttgtgacaaatatgggca | 2765 | 2784 | SEQ ID NO: | 4721 tgccagtttgaaaaacaaa | 11815 | 11834 | 2 | 3 |
| SEQ ID NO: 3381 ctgaggctaccatgacatt | 3252 | 3271 | SEQ ID NO: | 4722 aatgtcagctcttgttcag | 10903 | 10922 | 2 | 3 |
| SEQ ID NO: 3382 gtagataccaaaaaaatga | 3668 | 3687 | SEQ ID NO: | 4723 tcatttgccctcaacctac | 11450 | 11469 | 2 | 3 |
| SEQ ID NO: 3383 aaatgacttccaatttccc | 3681 | 3700 | SEQ ID NO: | 4724 gggaactgttgaaagattt | 12927 | 12946 | 2 | 3 |
| SEQ ID NO: 3384 atgacttccaatttccctg | 3683 | 3702 | SEQ ID NO: | 4725 caggagaacttactatcat | 13785 | 13804 | 2 | 3 |
| SEQ ID NO: 3385 atctgccatctcgagagtt | 4104 | 4123 | SEQ ID NO: | 4726 aactcctccactgaaagat | 9547 | 9566 | 2 | 3 |
| SEQ ID NO: 3386 atttgtttgtcaaagaagt | 4551 | 4570 | SEQ ID NO: | 4727 acttccgtttaccagaaat | 8247 | 8266 | 2 | 3 |
| SEQ ID NO: 3387 gcagagcttggcctctctg | 5135 | 5154 | SEQ ID NO: | 4728 cagagctttctgccactgc | 13518 | 13537 | 2 | 3 |
| SEQ ID NO: 3388 atatgctgaaatgaaattt | 5353 | 5372 | SEQ ID NO: | 4729 aaattcaaactgcctatat | 13874 | 13893 | 2 | 3 |
| SEQ ID NO: 3389 tcaaaacttgacaacattt | 5420 | 5439 | SEQ ID NO: | 4730 aaatacttccacaaattga | 8780 | 8799 | 2 | 3 |
| SEQ ID NO: 3390 cagtgacctgaaatacaat | 5512 | 5531 | SEQ ID NO: | 4731 attgaacatccccaaactg | 8794 | 8813 | 2 | 3 |
| SEQ ID NO: 3391 tacaaatggcaatgggaaa | 5848 | 5867 | SEQ ID NO: | 4732 tttcaactgcctttgtgta | 11229 | 11248 | 2 | 3 |
| SEQ ID NO: 3392 cttttgtaaagtatgataa | 6285 | 6304 | SEQ ID NO: | 4733 ttattgctgaatccaaaag | 13656 | 13675 | 2 | 3 |
| SEQ ID NO: 3393 ttgtaaagtatgataaaaa | 6288 | 6307 | SEQ ID NO: | 4734 ttttcaagcaaatgcacaa | 8539 | 8558 | 2 | 3 |
| SEQ ID NO: 3394 tccattaacctcccatttt | 6320 | 6339 | SEQ ID NO: | 4735 aaaagaaaattttgctgga | 10756 | 10775 | 2 | 3 |
| SEQ ID NO: 3395 gattatctgaattcattca | 6488 | 6507 | SEQ ID NO: | 4736 tgaagtagaccaacaaatc | 7162 | 7181 | 2 | 3 |
| SEQ ID NO: 3396 aattgggagagacaagttt | 6506 | 6525 | SEQ ID NO: | 4737 aaactaaatgatctaaatt | 11324 | 11343 | 2 | 3 |
| SEQ ID NO: 3397 atttgacaatagctattgc | 6696 | 6715 | SEQ ID NO: | 4738 gcaatttctgcacagaaat | 13441 | 13460 | 2 | 3 |
| SEQ ID NO: 3398 tgagcatgtcaaacacttt | 7060 | 7079 | SEQ ID NO: | 4739 aaagccattcagtctctca | 12971 | 12990 | 2 | 3 |
| SEQ ID NO: 3399 ttgaagatgttaacaaatt | 7356 | 7375 | SEQ ID NO: | 4740 aattccatatgaaagtcaa | 12660 | 12679 | 2 | 3 |
| SEQ ID NO: 3400 acttgtcacctacatttct | 7753 | 7772 | SEQ ID NO: | 4741 agaatattttgatccaagt | 13276 | 13295 | 2 | 3 |
| SEQ ID NO: 3401 gttttccacaccagaattt | 8050 | 8069 | SEQ ID NO: | 4742 aaatctggatttcttaaac | 9481 | 9500 | 2 | 3 |
| SEQ ID NO: 3402 ataagtacaaccaaaattt | 9405 | 9424 | SEQ ID NO: | 4743 aaataaatggagtctttat | 14083 | 14102 | 2 | 3 |
| SEQ ID NO: 3403 cgggacctgcggggctgag | 8 | 27 | SEQ ID NO: | 4744 ctcagttaactgtgtcccg | 11571 | 11590 | 1 | 3 |
| SEQ ID NO: 3404 agtgcccttctcggttgct | 25 | 44 | SEQ ID NO: | 4745 agcatctgattgactcact | 12678 | 12697 | 1 | 3 |
| SEQ ID NO: 3405 gctgaggagcccgcccagc | 47 | 66 | SEQ ID NO: | 4746 gctgattgaggtgtccagc | 1225 | 1244 | 1 | 3 |
| SEQ ID NO: 3406 gagcagcccgcccagcag | 50 | 69 | SEQ ID NO: | 4747 ctggatcacagagtccctc | 3752 | 3771 | 1 | 3 |
| SEQ ID NO: 3407 gggccgcgaggccgaggcc | 72 | 91 | SEQ ID NO: | 4748 ggccctgatccccgagccc | 1363 | 1382 | 1 | 3 |
| SEQ ID NO: 3408 ccaggccgcagcccaggag | 89 | 108 | SEQ ID NO: | 4749 ctcccggagccaaggctgg | 2682 | 2701 | 1 | 3 |
| SEQ ID NO: 3409 ggagccgccccaccgcagc | 104 | 123 | SEQ ID NO: | 4750 gctgttttgaagactctcc | 1088 | 1107 | 1 | 3 |
| SEQ ID NO: 3410 gaagaggaaatgctggaaa | 200 | 219 | SEQ ID NO: | 4751 tttcaagttcctgaccttc | 8309 | 8328 | 1 | 3 |
| SEQ ID NO: 3411 caaaagatgcgacccgatt | 237 | 256 | SEQ ID NO: | 4752 aatcttattggggattttg | 7085 | 7104 | 1 | 3 |
| SEQ ID NO: 3412 cttcaagcacctccggaag | 253 | 272 | SEQ ID NO: | 4753 cttccacatttcaggaat | 10067 | 10086 | 1 | 3 |
| SEQ ID NO: 3413 gttccagtggagtccctgg | 297 | 316 | SEQ ID NO: | 4754 ccagcaagtacctgagaac | 8810 | 8629 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3414 gactgctgattcaagaagt | 316 | 335 | SEQ ID NO: | 4755 acttgaagaaaagatagtc | 13324 | 13343 | 1 | 3 |
| SEQ ID NO: 3415 gtgccaccaggatcaactg | 333 | 352 | SEQ ID NO: | 4756 cagtgaagctgcagggcac | 10704 | 10723 | 1 | 3 |
| SEQ ID NO: 3416 gatcaactgcaaggttgag | 343 | 362 | SEQ ID NO: | 4757 ctcacctccacctctgatc | 4748 | 4767 | 1 | 3 |
| SEQ ID NO: 3417 actgcaaggttgagctgga | 348 | 367 | SEQ ID NO: | 4758 tccactcacatcctccagt | 1289 | 1308 | 1 | 3 |
| SEQ ID NO: 3418 ccagctctgcagcttcatc | 373 | 392 | SEQ ID NO: | 4759 gatgtggtcacctacctgg | 1343 | 1362 | 1 | 3 |
| SEQ ID NO: 3419 agcttcatcctgaagccca | 383 | 402 | SEQ ID NO: | 4760 tggtgctggagaatgagct | 5112 | 5131 | 1 | 3 |
| SEQ ID NO: 3420 cttcatcctgaagaccagc | 385 | 404 | SEQ ID NO: | 4761 gctggagtaaaactggaag | 2696 | 2715 | 1 | 3 |
| SEQ ID NO: 3421 ccagccagtgcaccctgaa | 399 | 418 | SEQ ID NO: | 4762 ttcaagatgactgcactgg | 1539 | 1558 | 1 | 3 |
| SEQ ID NO: 3422 cagtgcaccctgaaagagg | 404 | 423 | SEQ ID NO: | 4763 cctcacagagctatcactg | 5230 | 5249 | 1 | 3 |
| SEQ ID NO: 3423 tggcttcaaccctgagggc | 427 | 446 | SEQ ID NO: | 4764 gcccactggtcgcctgcca | 3533 | 3552 | 1 | 3 |
| SEQ ID NO: 3424 cttcaaccctgagggcaaa | 430 | 449 | SEQ ID NO: | 4765 tttgagccaacattggaag | 2207 | 2226 | 1 | 3 |
| SEQ ID NO: 3425 ttcaaccctgagggcaaag | 431 | 450 | SEQ ID NO: | 4766 ctttgacaggcattttgaa | 9727 | 9746 | 1 | 3 |
| SEQ ID NO: 3426 cttgctgaagaaaaccaag | 451 | 470 | SEQ ID NO: | 4767 cttgaaattcaatcacaag | 9074 | 9093 | 1 | 3 |
| SEQ ID NO: 3427 tgctgaagaaaaccaagaa | 453 | 472 | SEQ ID NO: | 4768 ttctgctgccttatcagca | 5647 | 5666 | 1 | 3 |
| SEQ ID NO: 3428 ttgctgcagccatgtccag | 483 | 502 | SEQ ID NO: | 4769 ctggtcagtttgcaagcaa | 3004 | 3023 | 1 | 3 |
| SEQ ID NO: 3429 tgctgcagccatgtccagg | 484 | 503 | SEQ ID NO: | 4770 cctggtcagtttgcaagca | 3003 | 3022 | 1 | 3 |
| SEQ ID NO: 3430 agccatgtccaggtatgag | 490 | 509 | SEQ ID NO: | 4771 ctcacatcctccagtggct | 1293 | 1312 | 1 | 3 |
| SEQ ID NO: 3431 agctcaagctggccattcc | 507 | 526 | SEQ ID NO: | 4772 ggaactaccacaaaaagct | 7489 | 7508 | 1 | 3 |
| SEQ ID NO: 3432 agaagggaagcaggttttc | 526 | 545 | SEQ ID NO: | 4773 gaaatcttcaatttattct | 13821 | 13840 | 1 | 3 |
| SEQ ID NO: 3433 cagggaagcaggttttcct | 528 | 547 | SEQ ID NO: | 4774 aggacaccaaaataacctt | 7572 | 7591 | 1 | 3 |
| SEQ ID NO: 3434 agaaagatgaacctactta | 555 | 574 | SEQ ID NO: | 4775 taagaactttgccacttct | 4852 | 4871 | 1 | 3 |
| SEQ ID NO: 3435 atcctgaacatcaagaggg | 575 | 594 | SEQ ID NO: | 4776 ccctaacagatttgaggat | 7977 | 7996 | 1 | 3 |
| SEQ ID NO: 3436 tcctgaacatcaagagggg | 576 | 595 | SEQ ID NO: | 4777 cccctaacagatttgagga | 7976 | 7995 | 1 | 3 |
| SEQ ID NO: 3437 ctgaacatcaagaggggca | 578 | 597 | SEQ ID NO: | 4778 tgcctgcctttgaagtcag | 7908 | 7927 | 1 | 3 |
| SEQ ID NO: 3438 aacatcaagcggggcatca | 581 | 600 | SEQ ID NO: | 4779 tgataaaaccaagatgtt | 6298 | 6317 | 1 | 3 |
| SEQ ID NO: 3439 acatcaagaggggcatcat | 582 | 601 | SEQ ID NO: | 4780 atgataaaaccaagatgt | 6297 | 8316 | 1 | 3 |
| SEQ ID NO: 3440 tcatttctgccctcctggt | 597 | 616 | SEQ ID NO: | 4781 accaccagtttgtagatga | 7413 | 7432 | 1 | 3 |
| SEQ ID NO: 3441 ttcccccagagacagaaga | 615 | 634 | SEQ ID NO: | 4782 tcttcacatttcaaggaa | 10066 | 10085 | 1 | 3 |
| SEQ ID NO: 3442 gaagaagccaagcaagtgt | 629 | 648 | SEQ ID NO: | 4783 acaccttccacattccttc | 8079 | 8098 | 1 | 3 |
| SEQ ID NO: 3443 ttgtttctggataccgtgt | 647 | 666 | SEQ ID NO: | 4784 acactaaatacttccacaa | 8775 | 8794 | 1 | 3 |
| SEQ ID NO: 3444 tgtatggaaactgctccac | 663 | 682 | SEQ ID NO: | 4785 gtggaggcaacacattaca | 2928 | 2947 | 1 | 3 |
| SEQ ID NO: 3445 aaactgctccactcacttt | 670 | 689 | SEQ ID NO: | 4786 aaagaaacagcatttgttt | 4540 | 4559 | 1 | 3 |
| SEQ ID NO: 3446 actcactttaccgtcaaga | 680 | 699 | SEQ ID NO: | 4787 tcttacttttccattgagt | 10580 | 10599 | 1 | 3 |
| SEQ ID NO: 3447 ctttaccgtcaagacgagg | 685 | 704 | SEQ ID NO: | 4788 cctccagctcctgggaaag | 2491 | 2510 | 1 | 3 |
| SEQ ID NO: 3448 ttaccgtcaagacgaggaa | 687 | 706 | SEQ ID NO: | 4789 ttcctaaagctggatgtaa | 11177 | 11196 | 1 | 3 |
| SEQ ID NO: 3449 acgaggaagggcaatgtgg | 698 | 717 | SEQ ID NO: | 4790 ccacaagtcatcatctcgt | 5964 | 5983 | 1 | 3 |
| SEQ ID NO: 3450 cgaggaagggcaatgtggc | 699 | 718 | SEQ ID NO: | 4791 gccagaagtgagatcctcg | 3515 | 3534 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3451 gaggaagggcaatgtggca | 700 | 719 | SEQ ID NO: | 4792 tgccagtctccatgacctc | 2476 | 2495 | 1 | 3 |
| SEQ ID NO: 3452 ggaagggccatgtggcaac | 702 | 721 | SEQ ID NO: | 4793 gttgctcttaaggacttcc | 13364 | 13383 | 1 | 3 |
| SEQ ID NO: 3453 gaagggcaatgtggcaaca | 703 | 722 | SEQ ID NO: | 4794 tgttgatgaggagtccttc | 1809 | 1828 | 1 | 3 |
| SEQ ID NO: 3454 caggcatcagcccacttgc | 777 | 796 | SEQ ID NO: | 4795 gcaagtctttcctggcctg | 3019 | 3038 | 1 | 3 |
| SEQ ID NO: 3455 aggcatcagcccacttgct | 778 | 797 | SEQ ID NO: | 4796 agcaagtctttcctggcct | 3018 | 3037 | 1 | 3 |
| SEQ ID NO: 3456 tcagcccacttgctctcat | 783 | 802 | SEQ ID NO: | 4797 atgaaagtcaagcatctga | 12668 | 12687 | 1 | 3 |
| SEQ ID NO: 3457 gtcaactctgatcagcagc | 823 | 842 | SEQ ID NO: | 4798 gctgactttaaaatctgac | 4819 | 4838 | 1 | 3 |
| SEQ ID NO: 3458 ggacgctaagaggaagcat | 865 | 884 | SEQ ID NO: | 4799 atgcactgtttctgagtcc | 9339 | 9358 | 1 | 3 |
| SEQ ID NO: 3459 aaggagcaacacctcttcc | 902 | 921 | SEQ ID NO: | 4800 ggaatatcttagcatcctt | 13465 | 13484 | 1 | 3 |
| SEQ ID NO: 3460 aggagcaacacctcttcct | 903 | 922 | SEQ ID NO: | 4801 aggaatatcttagcatcct | 13464 | 13483 | 1 | 3 |
| SEQ ID NO: 3461 caacacctcttcctgcctt | 908 | 927 | SEQ ID NO: | 4802 aaggctgactctgtggttg | 4292 | 4311 | 1 | 3 |
| SEQ ID NO: 3462 aacacctcttcctgccttt | 909 | 928 | SEQ ID NO: | 4803 aaagcaggccgaagctgtt | 1075 | 1094 | 1 | 3 |
| SEQ ID NO: 3463 acaagaataagtatgggat | 933 | 952 | SEQ ID NO: | 4804 atccatgatctacatttgt | 6794 | 6813 | 1 | 3 |
| SEQ ID NO: 3464 caagaataagtatgggatg | 934 | 953 | SEQ ID NO: | 4805 catcactttacaagccttg | 1246 | 1265 | 1 | 3 |
| SEQ ID NO: 3465 tagcacaagtgacacagac | 954 | 973 | SEQ ID NO: | 4806 gtctcttcgttctatgcta | 4592 | 4611 | 1 | 3 |
| SEQ ID NO: 3466 agcacaagtgacacagact | 955 | 974 | SEQ ID NO: | 4807 agtctcttcgttctatgct | 4591 | 4610 | 1 | 3 |
| SEQ ID NO: 3467 gcacaagtgacacagactt | 956 | 975 | SEQ ID NO: | 4808 aagtgtagtctcctggtgc | 5099 | 5118 | 1 | 3 |
| SEQ ID NO: 3468 aacttgaagacacaccaaa | 978 | 997 | SEQ ID NO: | 4809 tttgaggattccatcagtt | 7987 | 8006 | 1 | 3 |
| SEQ ID NO: 3469 gcttctttggtgaaggtac | 1008 | 1027 | SEQ ID NO: | 4810 gtacctacttttggcaagc | 8372 | 8391 | 1 | 3 |
| SEQ ID NO: 3470 ctttggtgaaggtactaag | 1012 | 1031 | SEQ ID NO: | 4811 cttatgggatttcctaaag | 11167 | 11186 | 1 | 3 |
| SEQ ID NO: 3471 tactaagaagatgggcctc | 1024 | 1043 | SEQ ID NO: | 4812 gagggtagtcataacagta | 10337 | 10356 | 1 | 3 |
| SEQ ID NO: 3472 tttgagagcaccaaatcca | 1046 | 1065 | SEQ ID NO: | 4813 tggaagtgtcagtggcaaa | 10380 | 10399 | 1 | 3 |
| SEQ ID NO: 3473 agagcaccaaatccacatc | 1050 | 1069 | SEQ ID NO: | 4814 gatggatatgaccttctct | 4876 | 4895 | 1 | 3 |
| SEQ ID NO: 3474 agctgttttgaagactctc | 1087 | 1106 | SEQ ID NO: | 4815 gagaacatactgggcagct | 5880 | 5899 | 1 | 3 |
| SEQ ID NO: 3475 tgaaaaaactaaccatctc | 1113 | 1132 | SEQ ID NO: | 4816 gagaaaatcaatgccttca | 7112 | 7131 | 1 | 3 |
| SEQ ID NO: 3476 gaaaaaactaaccatctct | 1114 | 1133 | SEQ ID NO: | 4817 agagccaggtcgagcttc | 11052 | 11071 | 1 | 3 |
| SEQ ID NO: 3477 tctgagcaaaatatccaga | 1130 | 1149 | SEQ ID NO: | 4818 tctgatgaggaaactcaga | 12260 | 12279 | 1 | 3 |
| SEQ ID NO: 3478 tctcttcaataagctggtt | 1156 | 1175 | SEQ ID NO: | 4819 aacctccattttttgaga | 6326 | 6345 | 1 | 3 |
| SEQ ID NO: 3479 ctgagctgagaggcctcag | 1176 | 1195 | SEQ ID NO: | 4820 ctgatccccgagccctcag | 1367 | 1386 | 1 | 3 |
| SEQ ID NO: 3480 tgaagcagtcacatctctc | 1198 | 1217 | SEQ ID NO: | 4821 gagaaaatcaatgccttca | 7112 | 7131 | 1 | 3 |
| SEQ ID NO: 3481 aagcagtcacatctctctt | 1200 | 1219 | SEQ ID NO: | 4822 aagaggcagcttctggctt | 12297 | 12316 | 1 | 3 |
| SEQ ID NO: 3482 ctctcttgccacagctgat | 1212 | 1231 | SEQ ID NO: | 4823 atcaaaagaagcccaagag | 12946 | 12965 | 1 | 3 |
| SEQ ID NO: 3483 tcttgccacagctgattga | 1215 | 1234 | SEQ ID NO: | 4824 tcaaagttaattgggaaga | 12279 | 12298 | 1 | 3 |
| SEQ ID NO: 3484 cttgccacagctgattgag | 1216 | 1235 | SEQ ID NO: | 4825 ctcaattttgattttcaag | 8528 | 8547 | 1 | 3 |
| SEQ ID NO: 3485 tgaggtgtccagccccatc | 1231 | 1250 | SEQ ID NO: | 4826 gatggaaccctctccctca | 4733 | 4752 | 1 | 3 |
| SEQ ID NO: 3486 tcagtgtggacagcctcag | 1267 | 1286 | SEQ ID NO: | 4827 ctgacatcttaggcactga | 5001 | 6020 | 1 | 3 |
| SEQ ID NO: 3487 acatcctccagtggctgaa | 1296 | 1315 | SEQ ID NO: | 4828 ttcagaagctaagcaatgt | 7239 | 7258 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3488 gcacagcagctgcgagaga | 1385 | 1404 | SEQ ID NO: | 4829 tctctgaaagacaacgtgc | 12323 | 12342 | 1 | 3 |
| SEQ ID NO: 3489 cagcagctgcgagagatct | 1388 | 1407 | SEQ ID NO: | 4830 agataacattaaacagctg | 13051 | 13070 | 1 | 3 |
| SEQ ID NO: 3490 gcgagggatcagcgcagcc | 1415 | 1434 | SEQ ID NO: | 4831 ggctcaacacagacatcgc | 5718 | 5737 | 1 | 3 |
| SEQ ID NO: 3491 aagacaaaccctacaggga | 1478 | 1497 | SEQ ID NO: | 4832 tcccagaaaacctcttctt | 3936 | 3955 | 1 | 3 |
| SEQ ID NO: 3492 caggagctgctggacattg | 1499 | 1518 | SEQ ID NO: | 4833 caatggagagtccaacctg | 4860 | 4679 | 1 | 3 |
| SEQ ID NO: 3493 aggagctgctggacattgc | 1500 | 1519 | SEQ ID NO: | 4834 gcaagggttcactgttcct | 7864 | 7883 | 1 | 3 |
| SEQ ID NO: 3494 ctgctggacattgctaatt | 1505 | 1524 | SEQ ID NO: | 4835 aattgggaagaagaggcag | 12287 | 12306 | 1 | 3 |
| SEQ ID NO: 3495 gattacacctatttgattc | 1565 | 1584 | SEQ ID NO: | 4836 gaatattttgagaggaatc | 6353 | 6372 | 1 | 3 |
| SEQ ID NO: 3496 atttgattctgcgggtcat | 1575 | 1594 | SEQ ID NO: | 4837 atgaagtagaccaacaaat | 7161 | 7180 | 1 | 3 |
| SEQ ID NO: 3497 tctgcgggtcattggaaat | 1582 | 1601 | SEQ ID NO: | 4838 atttgtaagaaaatacaga | 6436 | 6455 | 1 | 3 |
| SEQ ID NO: 3498 aaccatggagcagttaact | 1609 | 1628 | SEQ ID NO: | 4839 agtttctccatcctaggtt | 9962 | 9981 | 1 | 3 |
| SEQ ID NO: 3499 ggagcagttaactccagaa | 1615 | 1634 | SEQ ID NO: | 4840 ttctgaaaatccaatctcc | 8400 | 8419 | 1 | 3 |
| SEQ ID NO: 3500 actccagaactcaagtctt | 1625 | 1644 | SEQ ID NO: | 4841 aagatcgcagactttgagt | 11654 | 11673 | 1 | 3 |
| SEQ ID NO: 3501 tccagaactcaagtcttca | 1627 | 1646 | SEQ ID NO: | 4842 tgaactcagaagaattgga | 1920 | 1939 | 1 | 3 |
| SEQ ID NO: 3502 aagtacaaagccatcactg | 1663 | 1682 | SEQ ID NO: | 4843 cagtcatgtagaaaaactt | 4429 | 4448 | 1 | 3 |
| SEQ ID NO: 3503 gccatcactgatgatccag | 1672 | 1691 | SEQ ID NO: | 4844 ctggaactctctccatggc | 10883 | 10902 | 1 | 3 |
| SEQ ID NO: 3504 ccatcactgatgatccaga | 1673 | 1692 | SEQ ID NO: | 4845 tctgaactcagaaggatgg | 13999 | 14018 | 1 | 3 |
| SEQ ID NO: 3505 atccagaaagctgccatcc | 1685 | 1704 | SEQ ID NO: | 4846 ggatttcctaaagctggat | 11173 | 11192 | 1 | 3 |
| SEQ ID NO: 3506 cagaaagctgccatccagg | 1688 | 1707 | SEQ ID NO: | 4847 cctgaaatacaatgctctg | 5518 | 5537 | 1 | 3 |
| SEQ ID NO: 3507 acaaggaccaggaggttct | 1731 | 1750 | SEQ ID NO: | 4848 agaaacagcatttgtttgt | 4542 | 4561 | 1 | 3 |
| SEQ ID NO: 3508 aggaccaggaggttcttct | 1734 | 1753 | SEQ ID NO: | 4849 agaagctaagcaatgtcct | 7242 | 7261 | 1 | 3 |
| SEQ ID NO: 3509 accaggaggttcttcttca | 1737 | 1756 | SEQ ID NO: | 4850 tgaaggctgactctgtggt | 4290 | 4309 | 1 | 3 |
| SEQ ID NO: 3510 tcttcagactttccttgat | 1750 | 1769 | SEQ ID NO: | 4851 atcaggaagggctcaaaga | 2567 | 2586 | 1 | 3 |
| SEQ ID NO: 3511 ttcagactttccttgatga | 1752 | 1771 | SEQ ID NO: | 4852 tcattactcctgggctgaa | 11307 | 11326 | 1 | 3 |
| SEQ ID NO: 3512 gttgatgaggagtccttca | 1810 | 1829 | SEQ ID NO: | 4853 tgaatctggctccctcaac | 9046 | 9065 | 1 | 3 |
| SEQ ID NO: 3513 cttcacaggcagatattaa | 1824 | 1843 | SEQ ID NO: | 4854 ttaatcgagagtatgaag | 7148 | 7187 | 1 | 3 |
| SEQ ID NO: 3514 ttcacaggcagatattaac | 1825 | 1844 | SEQ ID NO: | 4855 gttaatcgagaggtatgaa | 7147 | 7166 | 1 | 3 |
| SEQ ID NO: 3515 ggcagatattaacaaaatt | 1831 | 1850 | SEQ ID NO: | 4856 aattgcattagatgatgcc | 6589 | 6608 | 1 | 3 |
| SEQ ID NO: 3516 atattaacaaaattgtcca | 1836 | 1855 | SEQ ID NO: | 4857 tggagtttgtgacaaatat | 2760 | 2779 | 1 | 3 |
| SEQ ID NO: 3517 acaaaattgtccaaattct | 1842 | 1861 | SEQ ID NO: | 4858 agaaacagcatttgtttgt | 4542 | 4561 | 1 | 3 |
| SEQ ID NO: 3518 gagcaagtgaagaactttg | 1877 | 1896 | SEQ ID NO: | 4859 caaatgacatgatgggctc | 5334 | 5353 | 1 | 3 |
| SEQ ID NO: 3519 gtgaagaactttgtggctt | 1883 | 1902 | SEQ ID NO: | 4860 aagcatctgattgactcac | 12677 | 12696 | 1 | 3 |
| SEQ ID NO: 3520 agaactttgtggcttccca | 1887 | 1906 | SEQ ID NO: | 4861 tgggcctgccccagattct | 8909 | 8928 | 1 | 3 |
| SEQ ID NO: 3521 tttgtggcttcccatattg | 1892 | 1911 | SEQ ID NO: | 4862 caataagatcaatagcaaa | 8998 | 9017 | 1 | 3 |
| SEQ ID NO: 3522 tggcttcccatattgccaa | 1896 | 1915 | SEQ ID NO: | 4863 ttggctcacatgaaggcca | 7631 | 7650 | 1 | 3 |
| SEQ ID NO: 3523 ttcccatattgccaatatc | 1900 | 1919 | SEQ ID NO: | 4864 gatatacactagggaggaa | 12745 | 12764 | 1 | 3 |
| SEQ ID NO: 3524 tcccatattgccaatatct | 1901 | 1920 | SEQ ID NO: | 4865 agatcaaagttaattggga | 12276 | 12295 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3525 ttgccaatatcttgaactc | 1908 | 1927 | SEQ ID NO: | 4866 gagtcccagtgcccagcaa | 9352 | 9371 | 1 | 3 |
| SEQ ID NO: 3526 ttggatatccaagatctga | 1934 | 1953 | SEQ ID NO: | 4867 tcagtataagtacaaccaa | 9400 | 9419 | 1 | 3 |
| SEQ ID NO: 3527 tccaagatctgaaaaagtt | 1941 | 1960 | SEQ ID NO: | 4868 aacttccaactgtcatgga | 1986 | 2005 | 1 | 3 |
| SEQ ID NO: 3528 ctgaaaaagttagtgaaag | 1949 | 1968 | SEQ ID NO: | 4869 ctttgaagtcagtcttcag | 7915 | 7934 | 1 | 3 |
| SEQ ID NO: 3529 agttagtgaaagaagttct | 1956 | 1975 | SEQ ID NO: | 4870 agaatctcaacttccaact | 1978 | 1997 | 1 | 3 |
| SEQ ID NO: 3530 aatctcaacttccaactgt | 1980 | 1999 | SEQ ID NO: | 4871 acaggggtcctttatgatt | 12350 | 12359 | 1 | 3 |
| SEQ ID NO: 3531 gtcatggacttcagaaaat | 1997 | 2016 | SEQ ID NO: | 4872 atttgaaagaataaatgac | 7036 | 7055 | 1 | 3 |
| SEQ ID NO: 3532 tcaactctacaaatctgtt | 2029 | 2048 | SEQ ID NO: | 4873 aacacattgaggctattga | 6978 | 6997 | 1 | 3 |
| SEQ ID NO: 3533 aactctacaaatctgtttc | 2031 | 2050 | SEQ ID NO: | 4874 gaaaaaggggattgaagtt | 10284 | 10303 | 1 | 3 |
| SEQ ID NO: 3534 aaatagaagggaatcttat | 2079 | 2098 | SEQ ID NO: | 4875 ataagcaaactgttaattt | 5457 | 5476 | 1 | 3 |
| SEQ ID NO: 3535 agaagggaatcttatattt | 2083 | 2102 | SEQ ID NO: | 4876 aaatgcactgctgcgttct | 4900 | 4919 | 1 | 3 |
| SEQ ID NO: 3536 gaagggaatcttatatttg | 2084 | 2103 | SEQ ID NO: | 4877 caaaaacatttcaacttc | 5287 | 5308 | 1 | 3 |
| SEQ ID NO: 3537 tgatccaaataactacctt | 2101 | 2120 | SEQ ID NO: | 4878 aaggaagaaagaaaaatca | 3461 | 3480 | 1 | 3 |
| SEQ ID NO: 3538 tggatttgcttcagctgac | 2158 | 2177 | SEQ ID NO: | 4879 gtcagcccagttccttcca | 10932 | 10951 | 1 | 3 |
| SEQ ID NO: 3539 tttgcttcagctgacctca | 2162 | 2181 | SEQ ID NO: | 4880 tgaggaaactcagatcaaa | 12265 | 12284 | 1 | 3 |
| SEQ ID NO: 3540 cttggaaggaaaaggcttt | 2191 | 2210 | SEQ ID NO: | 4881 aaagcattggtagagcaag | 7850 | 7869 | 1 | 3 |
| SEQ ID NO: 3541 tggaaggaaaaggcttga | 2193 | 2212 | SEQ ID NO: | 4882 tcaagtctgtgggattcca | 4086 | 4105 | 1 | 3 |
| SEQ ID NO: 3542 ggctttgagccaacattgg | 2204 | 2223 | SEQ ID NO: | 4883 ccaagaggtatttaaagcc | 12958 | 12977 | 1 | 3 |
| SEQ ID NO: 3543 tgagccaacattggaagct | 2209 | 2228 | SEQ ID NO: | 4884 agctttctgccactgctca | 13521 | 13540 | 1 | 3 |
| SEQ ID NO: 3544 gagccaacattggaagctc | 2210 | 2229 | SEQ ID NO: | 4885 gagctttctgccactgctc | 13520 | 13539 | 1 | 3 |
| SEQ ID NO: 3545 aacattggaagctcttttt | 2215 | 2234 | SEQ ID NO: | 4886 aaaagaaacagcatttgtt | 4539 | 4558 | 1 | 3 |
| SEQ ID NO: 3546 tggaagctcttttgggaa | 2220 | 2239 | SEQ ID NO: | 4887 ttccggcacgtgggttcca | 3785 | 3804 | 1 | 3 |
| SEQ ID NO: 3547 ctcttttgggaagcaagg | 2226 | 2245 | SEQ ID NO: | 4888 ccttactgactttgcagag | 7798 | 7817 | 1 | 3 |
| SEQ ID NO: 3548 tttttgggaagcaaggatt | 2229 | 2248 | SEQ ID NO: | 4889 aatcattgaaaaattaaaa | 6730 | 6749 | 1 | 3 |
| SEQ ID NO: 3549 ttttcccagacagtgtcaa | 2247 | 2266 | SEQ ID NO: | 4890 ttgatgaaatcattgaaaa | 6723 | 6742 | 1 | 3 |
| SEQ ID NO: 3550 ttggctataccaaagatga | 2331 | 2350 | SEQ ID NO: | 4891 tcattgctcccggagccaa | 2676 | 2695 | 1 | 3 |
| SEQ ID NO: 3551 ataccaaagatgataaaca | 2337 | 2356 | SEQ ID NO: | 4892 tgttgcttttgtaaagtat | 6280 | 8299 | 1 | 3 |
| SEQ ID NO: 3552 gagcaggatatggtaaatg | 2357 | 2376 | SEQ ID NO: | 4893 catttcagccttcgggctc | 4262 | 4281 | 1 | 3 |
| SEQ ID NO: 3553 atggtaaatggaataatgc | 2366 | 2385 | SEQ ID NO: | 4894 gcatgcctagtttctccat | 9954 | 9973 | 1 | 3 |
| SEQ ID NO: 3554 tggtaaatggaataatgct | 2367 | 2386 | SEQ ID NO: | 4895 agcacagtacgaaaaacca | 10809 | 10828 | 1 | 3 |
| SEQ ID NO: 3555 taaatggaataatgctcag | 2370 | 2389 | SEQ ID NO: | 4896 ctgaaagagatgaaattta | 13067 | 13086 | 1 | 3 |
| SEQ ID NO: 3556 tggaataatgctcagtgtt | 2374 | 2393 | SEQ ID NO: | 4897 aacagatttgaggattcca | 7981 | 8000 | 1 | 3 |
| SEQ ID NO: 3557 tcagtgttgagaagctgat | 2385 | 2404 | SEQ ID NO: | 4898 atcacaactcctccactga | 9542 | 9561 | 1 | 3 |
| SEQ ID NO: 3558 cagtgttgagaagctgatt | 2386 | 2405 | SEQ ID NO: | 4899 aatcacaactcctccactg | 9541 | 9560 | 1 | 3 |
| SEQ ID NO: 3559 agtgttgagaagctgatta | 2387 | 2406 | SEQ ID NO: | 4900 taatcacaactcctccact | 9540 | 9559 | 1 | 3 |
| SEQ ID NO: 3560 gattaaagatttgaaatcc | 2401 | 2420 | SEQ ID NO: | 4901 ggatactaagtaccaaatc | 6874 | 6893 | 1 | 3 |
| SEQ ID NO: 3561 gatttgaaatccaaagaag | 2408 | 2427 | SEQ ID NO: | 4902 cttccgtttaccagaaatc | 8248 | 8267 | 1 | 3 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3562 atttgaaatccaaagaagt | 2409 | 2428 | SEQ ID NO: 4903 acttccgtttaccagaaat | | 8247 | 8266 | 1 | 3 |
| SEQ ID NO: 3563 atccaaagaagtcccggaa | 2416 | 2435 | SEQ ID NO: 4904 ttccaatttccctgtggat | | 3688 | 3707 | 1 | 3 |
| SEQ ID NO: 3564 tccaaagaagtcccggaag | 2417 | 2436 | SEQ ID NO: 4905 cttccaatttccctgtgga | | 3687 | 3706 | 1 | 3 |
| SEQ ID NO: 3565 agagcctacctccgcatct | 2438 | 2457 | SEQ ID NO: 4906 agattaatccgctggctct | | 8571 | 8590 | 1 | 3 |
| SEQ ID NO: 3566 gagcctacctccgcatctt | 2439 | 2458 | SEQ ID NO: 4907 aagattaatccgctggctc | | 8570 | 8589 | 1 | 3 |
| SEQ ID NO: 3567 cttgggagaggagcttggt | 2455 | 2474 | SEQ ID NO: 4908 accactgggacctaccaag | | 12527 | 12546 | 1 | 3 |
| SEQ ID NO: 3568 ggagcttggttttgccagt | 2464 | 2483 | SEQ ID NO: 4909 actggtggccaaaccctcc | | 2734 | 2753 | 1 | 3 |
| SEQ ID NO: 3569 ttggttttgccagtctcca | 2469 | 2488 | SEQ ID NO: 4910 tggagaagccacactccaa | | 10771 | 10790 | 1 | 3 |
| SEQ ID NO: 3570 cagtctccatgacctccag | 2479 | 2498 | SEQ ID NO: 4911 ctggtcgcctgccaaactg | | 3538 | 3557 | 1 | 3 |
| SEQ ID NO: 3571 ctccatgacctccagctcc | 2483 | 2502 | SEQ ID NO: 4912 ggagtcattgctcccggag | | 2672 | 2691 | 1 | 3 |
| SEQ ID NO: 3572 ctgggaaagctgcttctga | 2501 | 2520 | SEQ ID NO: 4913 tcagaaagctaccttccag | | 7939 | 7958 | 1 | 3 |
| SEQ ID NO: 3573 gaggtcatcaggaagggct | 2561 | 2580 | SEQ ID NO: 4914 agccagaagtgagatcctc | | 3514 | 3533 | 1 | 3 |
| SEQ ID NO: 3574 aagaatgacttttttcttc | 2582 | 2601 | SEQ ID NO: 4915 gaaggcatctgggagtctt | | 3835 | 3854 | 1 | 3 |
| SEQ ID NO: 3575 cttttttcttcactacatc | 2590 | 2609 | SEQ ID NO: 4916 gatgcttacaacactaaag | | 6107 | 6126 | 1 | 3 |
| SEQ ID NO: 3576 catcttcatggagaatgcc | 2605 | 2624 | SEQ ID NO: 4917 ggcacttccaaaattgatg | | 10718 | 10737 | 1 | 3 |
| SEQ ID NO: 3577 cttcctggagaatgccttt | 2608 | 2627 | SEQ ID NO: 4918 aaagttaattgggaagaag | | 12281 | 12300 | 1 | 3 |
| SEQ ID NO: 3578 aatgcctttgaactcccca | 2618 | 2637 | SEQ ID NO: 4919 tgggctggcttcagccatt | | 5737 | 5756 | 1 | 3 |
| SEQ ID NO: 3579 gcctttgaactccccactg | 2621 | 2640 | SEQ ID NO: 4920 cagtctgaacattgcaggc | | 5383 | 5402 | 1 | 3 |
| SEQ ID NO: 3580 caaggctggagtaaaactg | 2692 | 2711 | SEQ ID NO: 4921 cagtgcaacgaccaacttg | | 5080 | 5099 | 1 | 3 |
| SEQ ID NO: 3581 tggagtaaaactggaagta | 2698 | 2717 | SEQ ID NO: 4922 tactcccacgccagctcca | | 3059 | 3078 | 1 | 3 |
| SEQ ID NO: 3582 ggaagtagccaacatgcag | 2710 | 2729 | SEQ ID NO: 4923 ctgccatctcgagagttcc | | 4106 | 4125 | 1 | 3 |
| SEQ ID NO: 3583 tttgtgacaaatatgggca | 2765 | 2784 | SEQ ID NO: 4924 tgcctttgtgtacaccaaa | | 11236 | 11255 | 1 | 3 |
| SEQ ID NO: 3584 tgtgacaaatatgggcatc | 2767 | 2786 | SEQ ID NO: 4925 gatgggtctctacgccaca | | 4385 | 4404 | 1 | 3 |
| SEQ ID NO: 3585 ggacttcgctaggagtggg | 2794 | 2813 | SEQ ID NO: 4926 cccaaggccacaggggtcc | | 12341 | 12360 | 1 | 3 |
| SEQ ID NO: 3586 gtggggtccagatgaacac | 2808 | 2827 | SEQ ID NO: 4927 gtgttctagacctctccac | | 4179 | 4198 | 1 | 3 |
| SEQ ID NO: 3587 ttccacgagtcgggtctgg | 2834 | 2853 | SEQ ID NO: 4928 ccagaatctgtaccaggaa | | 12562 | 12581 | 1 | 3 |
| SEQ ID NO: 3588 agtcgggtctggaggctca | 2841 | 2860 | SEQ ID NO: 4929 tgagaactacgagctgact | | 4807 | 4826 | 1 | 3 |
| SEQ ID NO: 3589 tcgggtctggaggctcatg | 2843 | 2862 | SEQ ID NO: 4930 catgaaggccaaattccga | | 7639 | 7658 | 1 | 3 |
| SEQ ID NO: 3590 aaaagctgggaagctgaag | 2869 | 2888 | SEQ ID NO: 4931 cttccagacacctgatttt | | 7951 | 7970 | 1 | 3 |
| SEQ ID NO: 3591 aagctgaagtttatcattc | 2879 | 2898 | SEQ ID NO: 4932 gaatttacaattgttgctt | | 6269 | 6288 | 1 | 3 |
| SEQ ID NO: 3592 gagaccagtcaagctgctc | 2908 | 2927 | SEQ ID NO: 4933 gagcttcaggaagcttctc | | 13214 | 13233 | 1 | 3 |
| SEQ ID NO: 3593 gcaacacattacatttggt | 2934 | 2953 | SEQ ID NO: 4934 accagtcagatattgttgc | | 10191 | 10210 | 1 | 3 |
| SEQ ID NO: 3594 acattacatttggtctcta | 2939 | 2958 | SEQ ID NO: 4935 tagaatatgaactaaatgt | | 11889 | 11908 | 1 | 3 |
| SEQ ID NO: 3595 cattacatttggtctctac | 2940 | 2959 | SEQ ID NO: 4936 gtagctgagaaaatcaatg | | 7106 | 7125 | 1 | 3 |
| SEQ ID NO: 3596 aaacggaggtgatcccacc | 2964 | 2983 | SEQ ID NO: 4937 ggtggatacctgaagtttt | | 3205 | 3224 | 1 | 3 |
| SEQ ID NO: 3597 attgagaacaggcagtcct | 2987 | 3006 | SEQ ID NO: 4938 aggaaaagcgcacctcaat | | 12031 | 12050 | 1 | 3 |
| SEQ ID NO: 3598 tgagaacaggcagtcctgg | 2989 | 3008 | SEQ ID NO: 4939 ccagcttccccacatctca | | 8341 | 8360 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3599 ctgcacctcaggcgcttac | 3043 | 3062 | SEQ ID NO: | 4940 gtaagaaaatacagagcag | 6440 | 6459 | 1 | 3 |
| SEQ ID NO: 3600 tccacagactccgcctcct | 3074 | 3093 | SEQ ID NO: | 4941 aggacagagccttggtgga | 3192 | 3211 | 1 | 3 |
| SEQ ID NO: 3601 ctgaccgggggacaccagat | 3101 | 3120 | SEQ ID NO: | 4942 atctgatgaggaaactcag | 12259 | 12278 | 1 | 3 |
| SEQ ID NO: 3602 tagagctggaactgaggcc | 3120 | 3139 | SEQ ID NO: | 4943 ggcctctctggggcatcta | 5144 | 5163 | 1 | 3 |
| SEQ ID NO: 3603 ctatgagctccagagagag | 3175 | 3194 | SEQ ID NO: | 4944 ctctcacaaaaaagtatag | 6549 | 6568 | 1 | 3 |
| SEQ ID NO: 3604 cttggtggataccctgaag | 3202 | 3221 | SEQ ID NO: | 4945 cttcaggaagcttctcaag | 13217 | 13236 | 1 | 3 |
| SEQ ID NO: 3605 ttgtaactcaagcagacgg | 3222 | 3241 | SEQ ID NO: | 4946 ccttacacaataatcacaa | 9530 | 9549 | 1 | 3 |
| SEQ ID NO: 3606 taactcaagcagaaggtgc | 3225 | 3244 | SEQ ID NO: | 4947 gcacctagctggaaagtta | 6955 | 6974 | 1 | 3 |
| SEQ ID NO: 3607 gcagaaggtgcgaagcaga | 3233 | 3252 | SEQ ID NO: | 4948 tctgtgggattccatctgc | 4091 | 4110 | 1 | 3 |
| SEQ ID NO: 3608 cagaaggtgcgaagcagac | 3234 | 3253 | SEQ ID NO: | 4949 gtctgtgggattccatctg | 4090 | 4109 | 1 | 3 |
| SEQ ID NO: 3609 gtatgaccttgtccagtga | 3288 | 3307 | SEQ ID NO: | 4950 tccccaacggagaacatac | 10851 | 10870 | 1 | 3 |
| SEQ ID NO: 3610 tatgaccttgtccagtgaa | 3289 | 3308 | SEQ ID NO: | 4951 ttcaccaacggagaacata | 10850 | 10869 | 1 | 3 |
| SEQ ID NO: 3611 gaagtccaaattccggatt | 3305 | 3324 | SEQ ID NO: | 4952 aatctcaagctttctcttc | 10052 | 10071 | 1 | 3 |
| SEQ ID NO: 3612 gagggcaaaacgtcttaca | 3371 | 3390 | SEQ ID NO: | 4953 tgtacaactggtccgcctc | 4215 | 4234 | 1 | 3 |
| SEQ ID NO: 3613 agggcaaaacgtcttacag | 3372 | 3391 | SEQ ID NO: | 4954 ctgttaggacaccagccct | 4062 | 4081 | 1 | 3 |
| SEQ ID NO: 3814 gactcaccctggacattca | 3390 | 3409 | SEQ ID NO: | 4955 tgaaattcaatcacaagtc | 9076 | 9095 | 1 | 3 |
| SEQ ID NO: 3615 ctggacattcagaacaaga | 3398 | 3417 | SEQ ID NO: | 4956 tcttttcttttcagcccag | 9226 | 9245 | 1 | 3 |
| SEQ ID NO: 3616 tcatgggcgacctaagttg | 3435 | 3454 | SEQ ID NO: | 4957 caactgcagacatatatga | 6635 | 6854 | 1 | 3 |
| SEQ ID NO: 3617 tgggcgacctaagttgtga | 3438 | 3457 | SEQ ID NO: | 4958 tcactccattaacctccca | 6316 | 6335 | 1 | 3 |
| SEQ ID NO: 3618 agttgtgacacaaaggaag | 3449 | 3468 | SEQ ID NO: | 4959 cttcttttccaattgaact | 13838 | 13857 | 1 | 3 |
| SEQ ID NO: 3619 tgacacaaaggaagaaaga | 3454 | 3473 | SEQ ID NO: | 4960 tcttcatcttcatctgtca | 10220 | 10239 | 1 | 3 |
| SEQ ID NO: 3620 gacacaaaggaagaaagaa | 3455 | 3474 | SEQ ID NO: | 4961 ttcttcatcttcatctgtc | 10219 | 10238 | 1 | 3 |
| SEQ ID NO: 3621 ggaagaaagaaaaatcaag | 3463 | 3482 | SEQ ID NO: | 4962 cttgtcatgcctacgttcc | 11348 | 11367 | 1 | 3 |
| SEQ ID NO: 3622 aaaatcaagggtgttattt | 3473 | 3492 | SEQ ID NO: | 4963 aaatcttattggggattt | 7084 | 7103 | 1 | 3 |
| SEQ ID NO: 3623 tccataccccgtttgcaag | 3491 | 3510 | SEQ ID NO: | 4964 cttggattcaaaatgtgga | 6858 | 6877 | 1 | 3 |
| SEQ ID NO: 3624 tgcaagcagaagccagaag | 3504 | 3523 | SEQ ID NO: | 4965 cttcagggaacacaatgca | 5185 | 5204 | 1 | 3 |
| SEQ ID NO: 3625 cagaagccagaagtgagat | 3510 | 3529 | SEQ ID NO: | 4966 atctatgccatctcttctg | 5633 | 5652 | 1 | 3 |
| SEQ ID NO: 3626 tgagatcctcgcccactgg | 3523 | 3542 | SEQ ID NO: | 4967 ccagcttccccacatctca | 8341 | 8360 | 1 | 3 |
| SEQ ID NO: 3627 ggtcgcctgccaaactgct | 3540 | 3559 | SEQ ID NO: | 4968 agcacatatgaactggacc | 13947 | 13966 | 1 | 3 |
| SEQ ID NO: 3628 tgcttctccaaatggactc | 3555 | 3574 | SEQ ID NO: | 4969 gagtttatcagtcagagca | 9701 | 9720 | 1 | 3 |
| SEQ ID NO: 3629 tggactcatctgctacagc | 3567 | 3586 | SEQ ID NO: | 4970 gctgcagtggcccgttcca | 8167 | 8186 | 1 | 3 |
| SEQ ID NO: 3630 gctacagcttatggctcca | 3578 | 3597 | SEQ ID NO: | 4971 tggaggacattcctctagc | 8211 | 8230 | 1 | 3 |
| SEQ ID NO: 3631 ggtggcatggcattatgat | 3610 | 3629 | SEQ ID NO: | 4972 atcacaaattagtttcacc | 8947 | 8966 | 1 | 3 |
| SEQ ID NO: 3632 agagaagattgaatttgaa | 3631 | 3650 | SEQ ID NO: | 4973 ttcaacgatacctgtctct | 7713 | 7732 | 1 | 3 |
| SEQ ID NO: 3633 caggcaccaatgtagatac | 3657 | 3676 | SEQ ID NO: | 4974 gtatgctaatagactcctg | 3736 | 3755 | 1 | 3 |
| SEQ ID NO: 3634 gacttccaatttccctgtg | 3685 | 3704 | SEQ ID NO: | 4975 cacaatgcaaaattcagtc | 5195 | 5214 | 1 | 3 |
| SEQ ID NO: 3635 gtccctcaaacagacatga | 3764 | 3783 | SEQ ID NO: | 4976 tcataagggaggtagggac | 12777 | 12795 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3636caaacagacatgactttcc | 3770 | 3789 | SEQ ID NO: | 4977ggaactacaatttcatttg | 7022 | 7041 | 1 | 3 |
| SEQ ID NO: 3637atagttgcaatgagctcat | 3809 | 3828 | SEQ ID NO: | 4978atgatttgaaaatagctat | 6693 | 6712 | 1 | 3 |
| SEQ ID NO: 3638gcttcagaaggcatctggg | 3829 | 3848 | SEQ ID NO: | 4979cccaagaggtatttaaagc | 12957 | 12976 | 1 | 3 |
| SEQ ID NO: 3639ggagttcaacctccagaac | 3895 | 3914 | SEQ ID NO: | 4980gttcactccattaacctcc | 6314 | 6333 | 1 | 3 |
| SEQ ID NO: 3640agaaaacctcttcttaaaa | 3940 | 3959 | SEQ ID NO: | 4981tttctaaatggaacttct | 12173 | 12192 | 1 | 3 |
| SEQ ID NO: 3641aaaacctcttcttaaaaag | 3942 | 3961 | SEQ ID NO: | 4982ctttgaaaaattctctttt | 9213 | 9232 | 1 | 3 |
| SEQ ID NO: 3642aaaaagcgatggccgggtc | 3955 | 3974 | SEQ ID NO: | 4983gaccttgcaagaatatttt | 6343 | 6362 | 1 | 3 |
| SEQ ID NO: 3643gtcaaatataccttgaaca | 3971 | 3990 | SEQ ID NO: | 4984tgttaacaaattccttgac | 7363 | 7382 | 1 | 3 |
| SEQ ID NO: 3644tgaacaagaacagtttgaa | 3984 | 4003 | SEQ ID NO: | 4985ttcaagttcctgaccttca | 8310 | 8329 | 1 | 3 |
| SEQ ID NO: 3645agtttgaaaattgagattc | 3995 | 4014 | SEQ ID NO: | 4986gaatctggctccctcaact | 9047 | 9066 | 1 | 3 |
| SEQ ID NO: 3646gtttgaaaattgagattcc | 3996 | 4015 | SEQ ID NO: | 4987ggaaataccaagtcaaaac | 10454 | 10473 | 1 | 3 |
| SEQ ID NO: 3647ttgaaaattgagattcctt | 3998 | 4017 | SEQ ID NO: | 4988aaggaaaagcgcacctcaa | 12030 | 12049 | 1 | 3 |
| SEQ ID NO: 3548ctaaagatgttagagactg | 4046 | 4065 | SEQ ID NO: | 4989cagttgaccacaagcttag | 10545 | 10564 | 1 | 3 |
| SEQ ID NO: 3649atgttagagactgttagga | 4052 | 4071 | SEQ ID NO: | 4990tccttaacaccttccacat | 8073 | 8092 | 1 | 3 |
| SEQ ID NO: 3650cagccctccacttcaagtc | 4074 | 4093 | SEQ ID NO: | 4991gacttctctagtcaggctg | 8813 | 8832 | 1 | 3 |
| SEQ ID NO: 3651agccctccacttcaagtct | 4075 | 4094 | SEQ ID NO: | 4992agacatcgctgggctggct | 5728 | 5747 | 1 | 3 |
| SEQ ID NO: 3652ccatctgccatctcgagag | 4102 | 4121 | SEQ ID NO: | 4993ctctcaaatgacatgatgg | 5330 | 5349 | 1 | 3 |
| SEQ ID NO: 3653attcccaagttgtatcaac | 4142 | 4161 | SEQ ID NO: | 4994gttgagaagccccaagaat | 6254 | 6273 | 1 | 3 |
| SEQ ID NO: 3654tcaactgcaagtgcctctc | 4156 | 4175 | SEQ ID NO: | 4995gagatcaagacactgttga | 8843 | 8862 | 1 | 3 |
| SEQ ID NO: 3655ggtgttctagacctctcca | 4178 | 4197 | SEQ ID NO: | 4996tggaaccctctccctcacc | 4735 | 4754 | 1 | 3 |
| SEQ ID NO: 3656ctccacgaatgtctacagc | 4192 | 4211 | SEQ ID NO: | 4997gctggtaacctaaaaggag | 5588 | 5607 | 1 | 3 |
| SEQ ID NO: 3657cacgaatgtctacagcaac | 4195 | 4214 | SEQ ID NO: | 4998gttgccaccatcatcgtg | 11671 | 11690 | 1 | 3 |
| SEQ ID NO: 3658acgaatgtctacagcaact | 4196 | 4215 | SEQ ID NO: | 4999agttgccaccatcatcgt | 11670 | 11689 | 1 | 3 |
| SEQ ID NO: 3659tcctccagtggtggcaaca | 4232 | 4251 | SEQ ID NO: | 5000tgttagttgctcttaagga | 13359 | 13378 | 1 | 3 |
| SEQ ID NO: 3660cgttaccacatgaaggctg | 4280 | 4299 | SEQ ID NO: | 5001cagcaagtacctgagaacg | 8611 | 8630 | 1 | 3 |
| SEQ ID NO: 3661gaaggctgactctgtggtt | 4291 | 4310 | SEQ ID NO: | 5002aacctatgccttaatcttc | 13169 | 13188 | 1 | 3 |
| SEQ ID NO: 3662tgtggttgacctgctttcc | 4303 | 4322 | SEQ ID NO: | 5003ggaaagttaaaacaacaca | 6965 | 6984 | 1 | 3 |
| SEQ ID NO: 3663cctgcttcctacaatgtg | 4312 | 4331 | SEQ ID NO: | 5004cacaccttgacattgcagg | 11088 | 11107 | 1 | 3 |
| SEQ ID NO: 3664ctgctttcctacaatgtgc | 4313 | 4332 | SEQ ID NO: | 5005gcacaccttgacattgcag | 11087 | 11106 | 1 | 3 |
| SEQ ID NO: 3665tcctacaatgtgcaaggat | 4319 | 4338 | SEQ ID NO: | 5006atccgctggctctgaagga | 8577 | 8596 | 1 | 3 |
| SEQ ID NO: 3666tatgaccacaagaatacgt | 4352 | 4371 | SEQ ID NO: | 5007acgtccgtgtgccttcata | 9984 | 10003 | 1 | 3 |
| SEQ ID NO: 3567atgaccacaagaatacgtc | 4353 | 4372 | SEQ ID NO: | 5008gacgtccgtgtgccttcat | 9983 | 10002 | 1 | ~ |
| SEQ ID NO: 3868gaatacgtctacactatca | 4363 | 4382 | SEQ ID NO: | 5009tgattatctgaattcattc | 6487 | 6506 | 1 | 3 |
| SEQ ID NO: 3669tttctagattcgaatatca | 4406 | 4425 | SEQ ID NO: | 5010tgatttacatgatttgaaa | 6685 | 6704 | 1 | 3 |
| SEQ ID NO: 3670gattcgaatatcaaattca | 4412 | 4431 | SEQ ID NO: | 5011tgaagtagctgagaaaatc | 7102 | 7121 | 1 | 3 |
| SEQ ID NO: 3671gaaacaacccagtctcaaa | 4449 | 4468 | SEQ ID NO: | 5012tttgaaaaattctctttc | 9214 | 9233 | 1 | 3 |
| SEQ ID NO: 3672cccagtctcaaaaggttta | 4456 | 4475 | SEQ ID NO: | 5013taaattcattactcctggg | 11302 | 11321 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3673 ctcaaaaggtttactaata | 4462 | 4481 | SEQ ID NO: 5014 tattcaaaactgagttgag | | 12231 | 12250 | 1 | 3 |
| SEQ ID NO: 3674 tcaaaaggtttactaatat | 4463 | 4482 | SEQ ID NO: 5015 atattcaaaactgagttga | | 12230 | 12249 | 1 | 3 |
| SEQ ID NO: 3675 aaaaggtttactaatattc | 4465 | 4484 | SEQ ID NO: 5016 gaatttgaaagttcgtttt | | 9280 | 9299 | 1 | 3 |
| SEQ ID NO: 3676 gaaacagcatttgtttgtc | 4543 | 4562 | SEQ ID NO: 5017 gacagcatcttcgtgtttc | | 11214 | 11233 | 1 | 3 |
| SEQ ID NO: 3677 atttgtttgtcaaagaagt | 4551 | 4570 | SEQ ID NO: 5018 acttaaaaaatataaaaat | | 8022 | 8041 | 1 | 3 |
| SEQ ID NO: 3678 tcaagattgatgggcagtt | 4569 | 4588 | SEQ ID NO: 5019 aactctcaagtcaagttga | | 13422 | 13441 | 1 | 3 |
| SEQ ID NO: 3679 ttcagagtctcttcgttct | 4586 | 4605 | SEQ ID NO: 5020 agaagatggcaaatttgaa | | 11995 | 12014 | 1 | 3 |
| SEQ ID NO: 3680 cagagtctcttcgttctat | 4588 | 4607 | SEQ ID NO: 5021 atagcatggacttcttctg | | 8873 | 8892 | 1 | 3 |
| SEQ ID NO: 3681 atgctaaaggcacatatgg | 4605 | 4624 | SEQ ID NO: 5022 ccatttgagatcacggcat | | 9245 | 9264 | 1 | 3 |
| SEQ ID NO: 3682 gcacatatggcctgtcttg | 4614 | 4633 | SEQ ID NO: 5023 caagttggcaagtaagtgc | | 9372 | 9391 | 1 | 3 |
| SEQ ID NO: 3683 gagtccaacctgaggttta | 4667 | 4686 | SEQ ID NO: 5024 taaagtgccacttttactc | | 6190 | 6209 | 1 | 3 |
| SEQ ID NO: 3684 agtccaacctgaggtttaa | 4668 | 4687 | SEQ ID NO: 5025 ttaacagggaagatagact | | 9308 | 9327 | 1 | 3 |
| SEQ ID NO: 3685 cctacctccaaggcaccaa | 4692 | 4711 | SEQ ID NO: 5026 ttggcaagtaagtgctagg | | 9376 | 9395 | 1 | 3 |
| SEQ ID NO: 3686 gaagatggaaccctctccc | 4730 | 4749 | SEQ ID NO: 5027 gggaagaagaggcagcttc | | 12291 | 12310 | 1 | 3 |
| SEQ ID NO: 3687 tgatctgcaaagtggcatc | 4762 | 4781 | SEQ ID NO: 5028 gatgaggaaactcagatca | | 12263 | 12282 | 1 | 3 |
| SEQ ID NO: 3688 gatctgcaaagtggcatca | 4763 | 4782 | SEQ ID NO: 5029 tgatgaggaaactcagatc | | 12262 | 12281 | 1 | 3 |
| SEQ ID NO: 3689 gcttccctaaagtatgaga | 4793 | 4812 | SEQ ID NO: 5030 tctcgtgtctaggaaaagc | | 5977 | 5996 | 1 | 3 |
| SEQ ID NO: 3690 gtatgagaactacgagctg | 4804 | 4823 | SEQ ID NO: 5031 cagcttaagagacacatac | | 6920 | 6939 | 1 | 3 |
| SEQ ID NO: 3691 tctaacaagatggatatga | 4868 | 4887 | SEQ ID NO: 5032 tcattttccaactaataga | | 13032 | 13051 | 1 | 3 |
| SEQ ID NO: 3692 ctgctgcgttctgaatatc | 4907 | 4926 | SEQ ID NO: 5033 gatacaagaaaaactgcag | | 6901 | 6920 | 1 | 3 |
| SEQ ID NO: 3693 tcattgaggttcttcagcc | 4940 | 4959 | SEQ ID NO: 5034 ggctcatatgctgaaatga | | 5348 | 5367 | 1 | 3 |
| SEQ ID NO: 3694 ttctggatcactaaattcc | 4963 | 4982 | SEQ ID NO: 5035 ggaaggacaaggcccagaa | | 12549 | 12568 | 1 | 3 |
| SEQ ID NO: 3695 ccatggtcttgagttaaat | 4981 | 5000 | SEQ ID NO: 5036 attttttattcctgccatgg | | 10103 | 10122 | 1 | 3 |
| SEQ ID NO: 3696 tcttaggcactgacaaaat | 5007 | 5026 | SEQ ID NO: 5037 attttttgcaagttaaaga | | 14019 | 14038 | 1 | 3 |
| SEQ ID NO: 3697 acaaggcgacactaaggat | 5040 | 5059 | SEQ ID NO: 5038 atccatgatctacatttgt | | 6794 | 6813 | 1 | 3 |
| SEQ ID NO: 3698 tgcaacgaccaacttgaag | 5083 | 5102 | SEQ ID NO: 5039 cttcagggaacacaatgca | | 5185 | 5204 | 1 | 3 |
| SEQ ID NO: 3699 caacttgaagtgtagtctc | 5092 | 5111 | SEQ ID NO: 5040 gagatgagagatgccgttg | | 6239 | 6258 | 1 | 3 |
| SEQ ID NO: 3700 gctggagaatgagctgaat | 5116 | 5135 | SEQ ID NO: 5041 attctcttttcttttcagc | | 9222 | 9241 | 1 | 3 |
| SEQ ID NO: 3701 gcagagcttggcctctctg | 5135 | 5154 | SEQ ID NO: 5042 cagatacaagaaaaactgc | | 6899 | 6918 | 1 | 3 |
| SEQ ID NO: 3702 tctctggggcatctatgaa | 5148 | 5167 | SEQ ID NO: 5043 ttcattcaattgggagaga | | 6499 | 6518 | 1 | 3 |
| SEQ ID NO: 3703 tctggggcatctatgaaat | 5150 | 5169 | SEQ ID NO: 5044 atttgtaagaaaatacaga | | 6436 | 6455 | 1 | 3 |
| SEQ ID NO: 3704 aacacaatgcaaaattcag | 5193 | 5212 | SEQ ID NO: 5045 ctgaagcattaaaactgtt | | 7506 | 7525 | 1 | 3 |
| SEQ ID NO: 3705 ctcacagagctatcactgg | 5231 | 5250 | SEQ ID NO: 5046 ccagatgctgaacagtgag | | 8149 | 8168 | 1 | 3 |
| SEQ ID NO: 3706 tgggaagtgcttatcaggc | 5247 | 5266 | SEQ ID NO: 5047 gcctacgttccatgtccca | | 11356 | 11375 | 1 | 3 |
| SEQ ID NO: 3707 ttcaaggtcagtcaagaag | 5303 | 5322 | SEQ ID NO: 5048 cttcagtgcagaatatgaa | | 11977 | 11996 | 1 | 3 |
| SEQ ID NO: 3708 aatgacatgatgggctcat | 5336 | 5355 | SEQ ID NO: 5049 atgattatctgaattcatt | | 6486 | 6505 | 1 | 3 |
| SEQ ID NO: 3709 gctcatatgctgaaatgaa | 5349 | 5368 | SEQ ID NO: 5050 ttcagccattgacatgagc | | 5746 | 5765 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3710 atatgctgaaatgaaattt | 5353 | 5372 | SEQ ID NO: | 5051 aaatagctattgctaatat | 6702 | 6721 | 1 | 3 |
| SEQ ID NO: 3711 tctgaacattgcaggctta | 5386 | 5405 | SEQ ID NO: | 5052 taagaaccagaagatcaga | 10996 | 11015 | 1 | 3 |
| SEQ ID NO: 3712 gaacattgcaggcttatca | 5389 | 5408 | SEQ ID NO: | 5053 tgatatcgacgtgaggttc | 12490 | 12509 | 1 | 3 |
| SEQ ID NO: 3713 tgcaggcttatcactggac | 5395 | 5414 | SEQ ID NO: | 5054 gtcctggattccacatgca | 11852 | 11871 | 1 | 3 |
| SEQ ID NO: 3714 tcaaaacttgacaacattt | 5420 | 5439 | SEQ ID NO: | 5055 aaattccttgacatgttga | 7370 | 7389 | 1 | 3 |
| SEQ ID NO: 3715 atttacagctctgacaagt | 5435 | 5454 | SEQ ID NO: | 5056 acttaaaaaatataaaaat | 8022 | 8041 | 1 | 3 |
| SEQ ID NO: 3716 ctctgacaagttttataag | 5443 | 5462 | SEQ ID NO: | 5057 cttacttgaattccaagag | 10674 | 10693 | 1 | 3 |
| SEQ ID NO: 3717 gttaatttacagctacagc | 5468 | 5487 | SEQ ID NO: | 5058 gctgcatgtggctggtaac | 5578 | 5597 | 1 | 3 |
| SEQ ID NO: 3718 ttctctggtaactactta | 5491 | 5510 | SEQ ID NO: | 5059 taaaagattactttgagaa | 7275 | 7294 | 1 | 3 |
| SEQ ID NO: 3719 cctaaaaggagcctaccaa | 5596 | 5615 | SEQ ID NO: | 5060 ttggcaagtaagtgctagg | 9376 | 9395 | 1 | 3 |
| SEQ ID NO: 3720 aaaaggagcctaccaaaat | 5599 | 5618 | SEQ ID NO: | 5061 atttacaattgttgctttt | 6271 | 6290 | 1 | 3 |
| SEQ ID NO: 3721 aggagcctaccaaaataat | 5602 | 5621 | SEQ ID NO: | 5062 attacctatgatttctcct | 10127 | 10146 | 1 | 3 |
| SEQ ID NO: 3722 ataatgaaataaaacacat | 5616 | 5635 | SEQ ID NO: | 5063 atgtcaaacactttgttat | 7065 | 7084 | 1 | 3 |
| SEQ ID NO: 3723 aaaacacatctatgccatc | 5626 | 5645 | SEQ ID NO: | 5064 gatgaagatgacgactttt | 12158 | 12177 | 1 | 3 |
| SEQ ID NO: 3724 tgctaaggttcagggtgtg | 5686 | 5705 | SEQ ID NO: | 5085 cacaagtcgattccagca | 9087 | 9106 | 1 | 3 |
| SEQ ID NO: 3725 gagtttagccatcggctca | 5705 | 5724 | SEQ ID NO: | 5066 tgaggtgactcagagactc | 7450 | 7469 | 1 | 3 |
| SEQ ID NO: 3726 gctggcttcagccattgac | 5740 | 5759 | SEQ ID NO: | 5067 gtcagtgaagttctccagc | 8596 | 8615 | 1 | 3 |
| SEQ ID NO: 3727 atttcagcaatgtcttccg | 5790 | 5809 | SEQ ID NO: | 5068 cggagcatgggagtgaaat | 8628 | 8647 | 1 | 3 |
| SEQ ID NO: 3728 tttcagcaatgtcttccgt | 5791 | 5810 | SEQ ID NO: | 5069 acggagcatgggagtgaaa | 8627 | 8646 | 1 | 3 |
| SEQ ID NO: 3729 ttcagcaatgtcttccgtt | 5792 | 5811 | SEQ ID NO: | 5070 aacggagcatgggagtgaa | 8626 | 8645 | 1 | 3 |
| SEQ ID NO: 3730 cagcaatgtcttccgttct | 5794 | 5813 | SEQ ID NO: | 5071 agaagtgtcttcaaagctg | 12412 | 12431 | 1 | 3 |
| SEQ ID NO: 3731 tgtcttccgttctgtaatg | 5800 | 5819 | SEQ ID NO: | 5072 cattcaattgggagagaca | 6501 | 6520 | 1 | 3 |
| SEQ ID NO: 3732 gtcttccgttctgtaatgg | 5801 | 5820 | SEQ ID NO: | 5073 ccattcagtctctcaagac | 12975 | 12994 | 1 | 3 |
| SEQ ID NO: 3733 atggaaactcgctctctg | 5859 | 5878 | SEQ ID NO: | 5074 cagataaaaaactcaccat | 12213 | 12232 | 1 | 3 |
| SEQ ID NO: 3734 ggagaacatactgggcagc | 5879 | 5898 | SEQ ID NO: | 5075 gctgttttgaagactctcc | 1088 | 1107 | 1 | 3 |
| SEQ ID NO: 3735 gttgaaagcagaacctctg | 5914 | 5933 | SEQ ID NO: | 5076 cagaattcataatcccaac | 8274 | 8293 | 1 | 3 |
| SEQ ID NO: 3736 gtctaggaaaagcatcagt | 5983 | 6002 | SEQ ID NO: | 5077 actgcaagattttcagac | 13612 | 13631 | 1 | 3 |
| SEQ ID NO: 3737 agcatcagtgcagctcttg | 5993 | 6012 | SEQ ID NO: | 5078 caagaacctgttagttgct | 13351 | 13370 | 1 | 3 |
| SEQ ID NO: 3738 ttgaacacaaagtcagtgc | 6009 | 6028 | SEQ ID NO: | 5079 gcacatcaatattgatcaa | 6418 | 6437 | 1 | 3 |
| SEQ ID NO: 3739 gcagacaggcacctggaaa | 6046 | 6065 | SEQ ID NO: | 5080 tttcagatggcattgctgc | 11610 | 11629 | 1 | 3 |
| SEQ ID NO: 3740 gaaactcaagacccaattt | 6061 | 6080 | SEQ ID NO: | 5081 aaatcccatccaggttttc | 8037 | 8056 | 1 | 3 |
| SEQ ID NO: 3741 acaatgaatacagccagga | 6084 | 6103 | SEQ ID NO: | 5082 tcctttggctgtgctttgt | 9682 | 9701 | 1 | 3 |
| SEQ ID NO: 3742 cttggatgcttacaacact | 6103 | 6122 | SEQ ID NO: | 5083 agtgaagttctccagcaag | 8599 | 8618 | 1 | 3 |
| SEQ ID NO: 3743 ttggcgtggagcttactgg | 6132 | 6151 | SEQ ID NO: | 5084 ccagaattcataatcccaa | 8273 | 8292 | 1 | 3 |
| SEQ ID NO: 3744 cacttttactcagtgagcc | 6198 | 6217 | SEQ ID NO: | 5085 ggctattgatgttagagtg | 6988 | 7007 | 1 | 3 |
| SEQ ID NO: 3745 tttagagatgagagatgcc | 6235 | 6254 | SEQ ID NO: | 5086 ggcatgatgctcatttaaa | 9177 | 9196 | 1 | 3 |
| SEQ ID NO: 3746 gagaagccccaagaattta | 6257 | 6276 | SEQ ID NO: | 5087 taaagccattcagtctctc | 12970 | 12989 | 1 | 3 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3747caattgttgcttttgtaaa | 6276 | 6295 | SEQ ID NO: | 5088tttaaccagtcagatattg | 10187 | 10206 | 1 | 3 |
| SEQ ID NO: 3748ttttgtaaagtatgataaa | 6286 | 6305 | SEQ ID NO: | 5089tttattgctgaatccaaaa | 13655 | 13674 | 1 | 3 |
| SEQ ID NO: 3749ttgtaaagtatgataaaaa | 6288 | 6307 | SEQ ID NO: | 5090ttttgagaggaatcgacaa | 6358 | 6377 | 1 | 3 |
| SEQ ID NO: 3750ttcactccattaacctccc | 6315 | 6334 | SEQ ID NO: | 5091gggaaaaaacaggcttgaa | 9576 | 9595 | 1 | 3 |
| SEQ ID NO: 3751ttttgagaccttgcaagaa | 6337 | 6356 | SEQ ID NO: | 5092ttctctctatgggaaaaaa | 9566 | 9585 | 1 | 3 |
| SEQ ID NO: 3752accttgcaagaatattttg | 6344 | 6363 | SEQ ID NO: | 5093caaaagaagcccaagaggt | 12948 | 12967 | 1 | 3 |
| SEQ ID NO: 3753tcaatattgatcaatttgt | 6423 | 6442 | SEQ ID NO: | 5094acaaagcagattatgttga | 11829 | 11848 | 1 | 3 |
| SEQ ID NO: 3754cagagcagccctgggaaaa | 6451 | 6470 | SEQ ID NO: | 5095ttttcagaccaactctctg | 13622 | 13641 | 1 | 3 |
| SEQ ID NO: 3755cctgggaaaactcccacag | 6460 | 6479 | SEQ ID NO: | 5096ctgtctctggtcagccagg | 7724 | 7743 | 1 | 3 |
| SEQ ID NO: 3756actcccacagcaagctaat | 6469 | 6488 | SEQ ID NO: | 5097attacacttcctttcgagt | 12869 | 12888 | 1 | 3 |
| SEQ ID NO: 3757aattcattcaattgggaga | 6497 | 6516 | SEQ ID NO: | 5098tctcttcctccatggaatt | 10479 | 10498 | 1 | 3 |
| SEQ ID NO: 3758ttcaattgggagagacaag | 6503 | 6522 | SEQ ID NO: | 5099cttggagtgccagtttgaa | 11808 | 11827 | 1 | 3 |
| SEQ ID NO: 3759aggagaaactgactgctct | 6534 | 6553 | SEQ ID NO: | 5100agagcttatgggatttcct | 11163 | 11182 | 1 | 3 |
| SEQ ID NO: 3760actgactgctctcacaaaa | 6541 | 6560 | SEQ ID NO: | 5101ttttggcaagctatacagt | 8380 | 8399 | 1 | 3 |
| SEQ ID NO: 3761gactgctctcacaaaaaag | 6544 | 6563 | SEQ ID NO: | 5102ctttgtgagtttatcagtc | 9695 | 9714 | 1 | 3 |
| SEQ ID NO: 3762cagacatatatgatacaat | 6641 | 6660 | SEQ ID NO: | 5103attggatatccaagatctg | 1933 | 1952 | 1 | 3 |
| SEQ ID NO: 3763aatttgatcagtatattaa | 6657 | 6676 | SEQ ID NO: | 5104ttaaaagaaatcttcaatt | 13815 | 13834 | 1 | 3 |
| SEQ ID NO: 3764tatgatttacatgatttga | 6683 | 6702 | SEQ ID NO: | 5105tcaatgattatatcccata | 13128 | 13147 | 1 | 3 |
| SEQ ID NO: 3765tttgaaaatagctattgct | 6697 | 6716 | SEQ ID NO: | 5106agcacagaaaaaattcaaa | 13864 | 13883 | 1 | 3 |
| SEQ ID NO: 3766ttgaaaatagctattgcta | 6698 | 6717 | SEQ ID NO: | 5107tagcacagaaaaaattcaa | 13863 | 13882 | 1 | 3 |
| SEQ ID NO: 3767aatagctattgctaatatt | 6703 | 6722 | SEQ ID NO: | 5108aataaatggagtctttatt | 14084 | 14103 | 1 | 3 |
| SEQ ID NO: 3768attattgatgaaatcattg | 6719 | 6738 | SEQ ID NO: | 5109caataccagaattcataat | 8268 | 8287 | 1 | 3 |
| SEQ ID NO: 3769aaagtcttgatgagcacta | 6747 | 6766 | SEQ ID NO: | 5110tagtgattacacttcsttt | 12864 | 12883 | 1 | 3 |
| SEQ ID NO: 3770aagtcttgatgagcactat | 6748 | 6767 | SEQ ID NO: | 5111atagcaacactaaatactt | 8769 | 8788 | 1 | 3 |
| SEQ ID NO: 3771ttgatgagcactatcatat | 6753 | 6772 | SEQ ID NO: | 5112atatccaagatgagatcaa | 13101 | 13120 | 1 | 3 |
| SEQ ID NO: 3772taattttagtaaaaacaat | 6777 | 6796 | SEQ ID NO: | 5113attgagattccctccatta | 11702 | 11721 | 1 | 3 |
| SEQ ID NO: 3773ttttagtaaaaacaatcca | 6780 | 6799 | SEQ ID NO: | 5114tggagtgccagtttgaaaa | 11810 | 11829 | 1 | 3 |
| SEQ ID NO: 3774acatttgtttattgaaaat | 6805 | 6824 | SEQ ID NO: | 5115atttcctaaagctggatgt | 11175 | 11194 | 1 | 3 |
| SEQ ID NO: 3775attgattttaacaaaagtg | 6824 | 6843 | SEQ ID NO: | 5116cactgttccagttgtcaat | 9871 | 9890 | 1 | 3 |
| SEQ ID NO: 3776attttaacaaaagtggaag | 6828 | 6847 | SEQ ID NO: | 5117cttcaaagacttaaaaaat | 8014 | 8033 | 1 | 3 |
| SEQ ID NO: 3777aaatcagaatccagataca | 6888 | 6907 | SEQ ID NO: | 5118tgtaccataagccatattt | 10088 | 10107 | 1 | 3 |
| SEQ ID NO: 3778gaatccagatacaagaaaa | 6894 | 6913 | SEQ ID NO: | 5119ttttctaaacttgaaattc | 9065 | 9084 | 1 | 3 |
| SEQ ID NO: 3779ttaagagacacatacagaa | 6924 | 6943 | SEQ ID NO: | 5120ttcttaaacattccttaa | 9491 | 9510 | 1 | 3 |
| SEQ ID NO: 3780atccagcacctagctggaa | 6950 | 6969 | SEQ ID NO: | 5121ttccaatttccctgtggat | 3688 | 3707 | 1 | 3 |
| SEQ ID NO: 3781tgagcatgtcaaacacttt | 7060 | 7079 | SEQ ID NO: | 5122aaagtgccacttttactca | 6191 | 6210 | 1 | 3 |
| SEQ ID NO: 3782gagcatgtcaaacactttg | 7061 | 7080 | SEQ ID NO: | 5123caaatgacatgatgggctc | 5334 | 5353 | 1 | 3 |
| SEQ ID NO: 3783aaacactttgttataaatc | 7070 | 7089 | SEQ ID NO: | 5124gattatatcccatatgttt | 13133 | 13152 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3784 tgagaaaatcaatgccttc | 7111 | 7130 | SEQ ID NO: 5125 gaaggaaaagcgcacctca | | 12029 | 12048 | 1 | 3 |
| SEQ ID NO: 3785 tatgaagtagaccaacaaa | 7160 | 7179 | SEQ ID NO: 5126 tttgtggagggtagtcata | | 10331 | 10350 | 1 | 3 |
| SEQ ID NO: 3786 aagtagaccaacaaatcca | 7164 | 7183 | SEQ ID NO: 5127 tggatgaagatgacgactt | | 12156 | 12175 | 1 | 3 |
| SEQ ID NO: 3787 aagttgaaggagactattc | 7223 | 7242 | SEQ ID NO: 5128 gaataccaatgctgaactt | | 10168 | 10187 | 1 | 3 |
| SEQ ID NO: 3788 acaagttaagataaaagat | 7264 | 7283 | SEQ ID NO: 5129 atctaaattcagttcttgt | | 11334 | 11353 | 1 | 3 |
| SEQ ID NO: 3789 aagataaaagattactttg | 7271 | 7290 | SEQ ID NO: 5130 caaaatagaagggaatctt | | 2077 | 2096 | 1 | 3 |
| SEQ ID NO: 3790 gattactttgagaaattag | 7280 | 7299 | SEQ ID NO: 5131 ctaaacttgaaattcaatc | | 9069 | 9088 | 1 | 3 |
| SEQ ID NO: 3791 tgagaaattagttggattt | 7288 | 7307 | SEQ ID NO: 5132 aaatccgtgaggtgactca | | 7443 | 7462 | 1 | 3 |
| SEQ ID NO: 3792 aaattagttggatttattg | 7292 | 7311 | SEQ ID NO: 5133 caattttgagaatgaattt | | 10419 | 10438 | 1 | 3 |
| SEQ ID NO: 3793 tggatttattgatgatgct | 7300 | 7319 | SEQ ID NO: 5134 agcatgcctagtttctcca | | 9953 | 9972 | 1 | 3 |
| SEQ ID NO: 3794 tcattgaagatgttaacaa | 7353 | 7372 | SEQ ID NO: 5135 ttgtagatgaaaccaatga | | 7422 | 7441 | 1 | 3 |
| SEQ ID NO: 3795 cattgaagatgttaacaaa | 7354 | 7373 | SEQ ID NO: 5136 tttgtagatgaaaccaatg | | 7421 | 7440 | 1 | 3 |
| SEQ ID NO: 3796 attgaagatgttaacaaat | 7355 | 7374 | SEQ ID NO: 5137 atttaagtatgatttcaat | | 10495 | 10514 | 1 | 3 |
| SEQ ID NO: 3797 ttgaagatgttaacaaatt | 7356 | 7375 | SEQ ID NO: 5138 aatttaagtatgatttcaa | | 10494 | 10513 | 1 | 3 |
| SEQ ID NO: 3798 tgaagatgttaacaaattc | 7357 | 7376 | SEQ ID NO: 5139 gaatttaagtatgatttca | | 10493 | 10512 | 1 | 3 |
| SEQ ID NO: 3799 acatgttgataaagaaatt | 7380 | 7399 | SEQ ID NO: 5140 aattccctgaagttgatgt | | 11487 | 11508 | 1 | 3 |
| SEQ ID NO: 3800 tttgattaccaccagtttg | 7406 | 7425 | SEQ ID NO: 5141 caaattgaacatccccaaa | | 8791 | 8810 | 1 | 3 |
| SEQ ID NO: 3801 caaaatccgtgaggtgact | 7441 | 7460 | SEQ ID NO: 5142 agtcccctaacagatttg | | 7972 | 7991 | 1 | 3 |
| SEQ ID NO: 3802 aaaatccgtgaggtgactc | 7442 | 7461 | SEQ ID NO: 5143 gagtgaaatgctgtttttt | | 8638 | 8657 | 1 | 3 |
| SEQ ID NO: 3803 aggtgactcagagactcaa | 7452 | 7471 | SEQ ID NO: 5144 ttgatgatatctggaacct | | 10731 | 10750 | 1 | 3 |
| SEQ ID NO: 3804 gtgaaattcaggctctgga | 7473 | 7492 | SEQ ID NO: 5145 tccaatctcctcttttcac | | 8409 | 8428 | 1 | 3 |
| SEQ ID NO: 3805 gttgcagtgtatctggaaa | 7547 | 7566 | SEQ ID NO: 5146 tttcaagcaaatgcacaac | | 8540 | 8559 | 1 | 3 |
| SEQ ID NO: 3806 ttaagttcagcatctttgg | 7616 | 7635 | SEQ ID NO: 5147 ccaatgctgaacttttaa | | 10173 | 10192 | 1 | 3 |
| SEQ ID NO: 3807 tgaaggccaaattccgaga | 7641 | 7660 | SEQ ID NO: 5148 tctcctttcttcatcttca | | 10213 | 10232 | 1 | 3 |
| SEQ ID NO: 3808 aatgtatcaaatggacatt | 7684 | 7703 | SEQ ID NO: 5149 aatgaagtccggattcatt | | 11021 | 11040 | 1 | 3 |
| SEQ ID NO: 3809 attcagcaggaacttcaac | 7700 | 7719 | SEQ ID NO: 5150 gttgagaagccccaagaat | | 6254 | 6273 | 1 | 3 |
| SEQ ID NO: 3810 acctgtctctggtcagcca | 7722 | 7741 | SEQ ID NO: 5151 tggcaagtaagtgctaggt | | 9377 | 9396 | 1 | 3 |
| SEQ ID NO: 3811 cctgtctctggtcagccag | 7723 | 7742 | SEQ ID NO: 5152 ctggacttctctagtcagg | | 8810 | 8829 | 1 | 3 |
| SEQ ID NO: 3812 ggtcagccaggtttatagc | 7732 | 7751 | SEQ ID NO: 5153 gctaaaggagcagttgacc | | 10535 | 10554 | 1 | 3 |
| SEQ ID NO: 3813 ccaggtttatagcacactt | 7738 | 7757 | SEQ ID NO: 5154 aagtccggattcattctgg | | 11025 | 11044 | 1 | 3 |
| SEQ ID NO: 3814 gtttatagcacacttgtca | 7742 | 7761 | SEQ ID NO: 5155 tgacctgtccattcaaaac | | 13681 | 13700 | 1 | 3 |
| SEQ ID NO: 3815 acttgtcacctacatttct | 7753 | 7772 | SEQ ID NO: 5156 agaaaaggggattgaagt | | 10283 | 10302 | 1 | 3 |
| SEQ ID NO: 3816 ctgattggtggactcttgc | 7770 | 7789 | SEQ ID NO: 5157 gcaagttaaagaaaatcag | | 14026 | 14045 | 1 | 3 |
| SEQ ID NO: 3817 atgaaagcattggtagagc | 7847 | 7866 | SEQ ID NO: 5158 gctcatctcctttcttcat | | 10208 | 10227 | 1 | 3 |
| SEQ ID NO: 3818 tgaaagcattggtagagca | 7848 | 7867 | SEQ ID NO: 5159 tgctcatctcctttcttca | | 10207 | 10226 | 1 | 3 |
| SEQ ID NO: 3819 gggttcactgttcctgaaa | 7868 | 7887 | SEQ ID NO: 5160 tttcaccatagaaggaccc | | 8959 | 8978 | 1 | 3 |
| SEQ ID NO: 3820 tcaagaccatccttgggac | 7887 | 7906 | SEQ ID NO: 5161 gtcccctaacagatttga | | 7973 | 7992 | 1 | 3 |

TABLE 9-continued

Selected palindromic sequences from human ApoB

| Source | Start Index | End Index | Match Index | Start Index | End # | B | |
|---|---|---|---|---|---|---|---|
| SEQ ID NO: 3821 ccttgggaccatgcctgcc | 7897 | 7916 | SEQ ID NO: 5162 ggcaccagggctcggaagg | 13978 | 13997 | 1 | 3 |
| SEQ ID NO: 3822 ttcaggctcttcagaaagc | 7929 | 7948 | SEQ ID NO: 5163 gcttgaaggcattcttgaa | 9588 | 9607 | 1 | 3 |
| SEQ ID NO: 3823 ttcagataaacttcaaaga | 8004 | 8023 | SEQ ID NO: 5164 tcttcataagttcaatgaa | 13183 | 13202 | 1 | 3 |
| SEQ ID NO: 3824 acttcaaagacttaaaaaa | 8013 | 8032 | SEQ ID NO: 5165 tttttaacaaaagtggaagt | 6829 | 6848 | 1 | 3 |
| SEQ ID NO: 3825 atcccatccaggttttcca | 8039 | 8058 | SEQ ID NO: 5166 tggagaagcaaatctggat | 9472 | 9491 | 1 | 3 |
| SEQ ID NO: 3826 gaatttaccatccttaaca | 8063 | 8082 | SEQ ID NO: 5167 tgttgaagtgtctccattc | 9889 | 9908 | 1 | 3 |
| SEQ ID NO: 3827 cattccttcctttacaatt | 8089 | 8108 | SEQ ID NO: 5168 aattccaattttgagaatg | 10414 | 10433 | 1 | 3 |
| SEQ ID NO: 3828 ttgaccagatgctgaacag | 8145 | 8164 | SEQ ID NO: 5169 ctgttgaaagatttatcaa | 12932 | 12951 | 1 | 3 |
| SEQ ID NO: 3829 aatcaccctgccagacttc | 8233 | 8252 | SEQ ID NO: 5170 gaagttctcaattttgatt | 8522 | 8541 | 1 | 3 |
| SEQ ID NO: 3830 tgaccttcccataccagaa | 8320 | 8339 | SEQ ID NO: 5171 ttcttctggaaaagggtca | 8884 | 8903 | 1 | 3 |
| SEQ ID NO: 3831 ttccagcttccccacatct | 8339 | 8358 | SEQ ID NO: 5172 agattctcagatgagggaa | 8921 | 8940 | 1 | 3 |
| SEQ ID NO: 3832 aagctatacagtattctga | 8387 | 8406 | SEQ ID NO: 5173 tcagatggcattgctgctt | 11612 | 11631 | 1 | 3 |
| SEQ ID NO: 3833 attctgaaaatccaatctc | 8399 | 8418 | SEQ ID NO: 5174 gagataaccgtgcctgaat | 11552 | 11571 | 1 | 3 |
| SEQ ID NO: 3834 tttcacattagatgcaaat | 8422 | 8441 | SEQ ID NO: 5175 attttgaaaaaaacagaaa | 9738 | 9757 | 1 | 3 |
| SEQ ID NO: 3835 caaatgctgacataggaa | 8436 | 8455 | SEQ ID NO: 5176 ttccatcacaaatcctttg | 9670 | 9689 | 1 | 3 |
| SEQ ID NO: 3836 gagagtccaaattagaagt | 8508 | 8527 | SEQ ID NO: 5177 actttacttcccaactctc | 13410 | 13429 | 1 | 3 |
| SEQ ID NO: 3837 agagtccaaattagaagtt | 8509 | 8528 | SEQ ID NO: 5178 aactttacttcccaactct | 13409 | 13428 | 1 | 3 |
| SEQ ID NO: 3838 tctcaattttgattttcaa | 8527 | 8546 | SEQ ID NO: 5179 ttgattccctttttgaga | 11537 | 11556 | 1 | 3 |
| SEQ ID NO: 3839 caattttgattttcaagca | 8530 | 8549 | SEQ ID NO: 5180 tgctgaatccaaaagattg | 13660 | 13679 | 1 | 3 |
| SEQ ID NO: 3840 aatgcacaactctcaaacc | 8549 | 8568 | SEQ ID NO: 5181 ggtttatcaaggggccatt | 12460 | 12479 | 1 | 3 |
| SEQ ID NO: 3841 agttctccagcaagtacct | 8604 | 8623 | SEQ ID NO: 5182 aggttccatcgtgcaaact | 11388 | 11407 | 1 | 3 |
| SEQ ID NO: 3842 agtacctgagaacggagca | 8616 | 8635 | SEQ ID NO: 5183 tgctccaggagaacttact | 13780 | 13799 | 1 | 3 |
| SEQ ID NO: 3843 tcaaacacagtggcaagtt | 8678 | 8697 | SEQ ID NO: 5184 aactctcaagtcaagttga | 13422 | 13441 | 1 | 3 |
| SEQ ID NO: 3844 acaatcagcttaccctgga | 8751 | 8770 | SEQ ID NO: 5185 tccattctgaatatattgt | 13380 | 13399 | 1 | 3 |
| SEQ ID NO: 3845 ctggatagcaacactaaat | 8765 | 8784 | SEQ ID NO: 5186 attttctgaacttccccag | 12702 | 12721 | 1 | 3 |
| SEQ ID NO: 3846 ctgacctgcgcaacgagat | 8829 | 8848 | SEQ ID NO: 5187 atctgatgaggaaactcag | 12259 | 12278 | 1 | 3 |
| SEQ ID NO: 3847 agatgagggaacacatgaa | 8929 | 8948 | SEQ ID NO: 5188 ttcatgtccctagaaatct | 10038 | 10057 | 1 | 3 |
| SEQ ID NO: 3848 tcaacttttctaaacttga | 9060 | 9079 | SEQ ID NO: 5189 tcaaggataacgtgtttga | 12618 | 12637 | 1 | 3 |
| SEQ ID NO: 3849 ttctaaacttgaaattcaa | 9067 | 9086 | SEQ ID NO: 5190 ttgatgatgctgtcaagaa | 7308 | 7327 | 1 | 3 |
| SEQ ID NO: 3850 gaaattcaatcacaagtcg | 9077 | 9096 | SEQ ID NO: 5191 cgacgaagaaaatcattta | 13566 | 13585 | 1 | 3 |
| SEQ ID NO: 3851 cactgtttggagaagggaa | 9141 | 9160 | SEQ ID NO: 5192 ttccagaaagcagccagtg | 12506 | 12525 | 1 | 3 |
| SEQ ID NO: 3852 actgtttggagaagggaag | 9142 | 9161 | SEQ ID NO: 5193 cttccccaaagagaccagt | 2898 | 2917 | 1 | 3 |
| SEQ ID NO: 3853 aattctcttttcttttcag | 9221 | 9240 | SEQ ID NO: 5194 ctgattactatgaaaaatt | 13638 | 13657 | 1 | 3 |
| SEQ ID NO: 3854 ttcttttcagcccagccat | 9230 | 9249 | SEQ ID NO: 5195 atggaaagggaaagagaa | 13494 | 13513 | 1 | 3 |
| SEQ ID NO: 3855 tttgaaagtcgttttcca | 9283 | 9302 | SEQ ID NO: 5196 tggaagtgtcagtggcaaa | 10380 | 10399 | 1 | 3 |
| SEQ ID NO: 3856 cagggaagatagacttcct | 9312 | 9331 | SEQ ID NO: 5197 aggacctttcaaattcctg | 9848 | 9867 | 1 | 3 |
| SEQ ID NO: 3857 ataagtacaaccaaaattt | 9405 | 9424 | SEQ ID NO: 5198 aaatcaggatctgagttat | 14038 | 14057 | 1 | 3 |

TABLE 9-continued

Selected palindromic sequences from human ApoB

| Source | Start Index | End Index | Match | Index | Start Index | End # | B | |
|---|---|---|---|---|---|---|---|---|
| SEQ ID NO: 3858 acaacgagaacattatgga | 9435 | 9454 | SEQ ID NO: | 5199 tccattctgaatatattgt | 13380 | 13399 | 1 | 3 |
| SEQ ID NO: 3859 aggaataaatggagaagca | 9463 | 9482 | SEQ ID NO: | 5200 tgctggaattgtcattcct | 11734 | 11753 | 1 | 3 |
| SEQ ID NO: 3860 agcaaatctggatttctta | 9478 | 9497 | SEQ ID NO: | 5201 taagttctctgtacctgct | 11719 | 11738 | 1 | 3 |
| SEQ ID NO: 3861 tcctttaacaattcctgaa | 9502 | 9521 | SEQ ID NO: | 5202 ttcaaaacgagcttcagga | 13206 | 13225 | 1 | 3 |
| SEQ ID NO: 3862 tttaacaattcctgaaatg | 9505 | 9524 | SEQ ID NO: | 5203 catttgatttaagtgtaaa | 9621 | 9540 | 1 | 3 |
| SEQ ID NO: 3863 acacaataatcacaactcc | 9534 | 9553 | SEQ ID NO: | 5204 ggagacagcatcttcgtgt | 11211 | 11230 | 1 | 3 |
| SEQ ID NO: 3864 aagatttctctctatggga | 9561 | 9580 | SEQ ID NO: | 5205 tcccagaaaacctcttctt | 3936 | 3955 | 1 | 3 |
| SEQ ID NO: 3865 gaaaaaacaggcttgaagg | 9578 | 9597 | SEQ ID NO: | 5206 ccttttacaattcattttc | 13021 | 13040 | 1 | 3 |
| SEQ ID NO: 3866 ttgaaggaattcttgaaaa | 9590 | 9609 | SEQ ID NO: | 5207 ttttgagaatgaatttcaa | 10422 | 10441 | 1 | 3 |
| SEQ ID NO: 3867 tgaaggaattcttgaaaac | 9591 | 9610 | SEQ ID NO: | 5208 gttttggctgataaattca | 11291 | 11310 | 1 | 3 |
| SEQ ID NO: 3868 agctcagtataagaaaaac | 9640 | 9659 | SEQ ID NO: | 5209 gtttgataagtacaaagct | 9805 | 9824 | 1 | 3 |
| SEQ ID NO: 3869 tcaaatcctttgacaggca | 9720 | 9739 | SEQ ID NO: | 5210 tgcctgagcagaccattga | 11688 | 11707 | 1 | 3 |
| SEQ ID NO: 3870 atgaaacaaaaattaagtt | 9789 | 9808 | SEQ ID NO: | 5211 aactttgcactatgttcat | 12762 | 12781 | 1 | 3 |
| SEQ ID NO: 3871 aattcctggatacactgtt | 9859 | 9878 | SEQ ID NO: | 5212 aacacatgaatcacaaatt | 8938 | 8957 | 1 | 3 |
| SEQ ID NO: 3872 ttccagttgtcaatgttga | 9876 | 9895 | SEQ ID NO: | 5213 tcaaaacgagcttcaggaa | 13207 | 13226 | 1 | 3 |
| SEQ ID NO: 3873 aagtgtctccattcaccat | 9894 | 9913 | SEQ ID NO: | 5214 atgggaagtataagaactt | 4842 | 4861 | 1 | 3 |
| SEQ ID NO: 3874 gtcagcatgcctagtttct | 9950 | 9969 | SEQ ID NO: | 5215 agaaaaggcacaccttgac | 11080 | 11099 | 1 | 3 |
| SEQ ID NO: 3875 ctgccatgggcaatattac | 10113 | 10132 | SEQ ID NO: | 5216 gtaagaaaatacagagcag | 6440 | 6459 | 1 | 3 |
| SEQ ID NO: 3876 tgaataccaatgctgaact | 10167 | 10186 | SEQ ID NO: | 5217 agttgaaggagactattca | 7224 | 7243 | 1 | 3 |
| SEQ ID NO: 3877 tattgttgctcatctcctt | 10201 | 10220 | SEQ ID NO: | 5218 aaggaaacataaactaata | 12889 | 12908 | 1 | 3 |
| SEQ ID NO: 3878 tgttgctcatctcctttct | 10204 | 10223 | SEQ ID NO: | 5219 agaagaaatctgcagaaca | 12431 | 12450 | 1 | 3 |
| SEQ ID NO: 3879 tctgtcattgatgcactgc | 10232 | 10251 | SEQ ID NO: | 5220 gcagtagactataagcaga | 13928 | 13947 | 1 | 3 |
| SEQ ID NO: 3880 ccacagctctgtctctgag | 10305 | 10324 | SEQ ID NO: | 5221 ctcagggatctgaaggtgg | 8195 | 8214 | 1 | 3 |
| SEQ ID NO: 3881 atttgtggagggtagtcat | 10330 | 10349 | SEQ ID NO: | 5222 atgaagtagaccaacaaat | 7161 | 7180 | 1 | 3 |
| SEQ ID NO: 3882 atatggaagtgtcagtggc | 10377 | 10396 | SEQ ID NO: | 5223 gccacactccaacgcatat | 10778 | 10797 | 1 | 3 |
| SEQ ID NO: 3883 tggaaataccaagtcaaaa | 10453 | 10472 | SEQ ID NO: | 5224 ttttacaattcattttcca | 13023 | 13042 | 1 | 3 |
| SEQ ID NO: 3684 aagtcaaaacctactgtct | 10463 | 10482 | SEQ ID NO: | 5225 agacctagtgattacactt | 12859 | 12878 | 1 | 3 |
| SEQ ID NO: 3885 actgtctcttcctccatgg | 10475 | 10494 | SEQ ID NO: | 5226 ccatgcaagtcagcccagt | 10924 | 10943 | 1 | 3 |
| SEQ ID NO: 3886 cttcctccatggaatttaa | 10482 | 10501 | SEQ ID NO: | 5227 ttaatcgagaggtatgaag | 7148 | 7167 | 1 | 3 |
| SEQ ID NO: 3887 attcttcaatgctgtactc | 10512 | 10531 | SEQ ID NO: | 5228 gagttgagggtccgggaat | 12242 | 12261 | 1 | 3 |
| SEQ ID NO: 3888 ttgaccacaagcttagctt | 10548 | 10567 | SEQ ID NO: | 5231 aagcgcacctcaatatcaa | 12036 | 12055 | 1 | 3 |
| SEQ ID NO: 3889 cctcacctcttacttttcc | 10573 | 10592 | SEQ ID NO: | 5232 ggaactattgctagtgagg | 10649 | 10668 | 1 | 3 |
| SEQ ID NO: 3890 agctgcagggcacttccaa | 10710 | 10729 | SEQ ID NO: | 5233 ttgggaagaagaggcagct | 12289 | 12308 | 1 | 3 |
| SEQ ID NO: 3891 ttccaaaattgatgatatc | 10723 | 10742 | SEQ ID NO: | 5234 gatatacactagggaggaa | 12745 | 12764 | 1 | 3 |
| SEQ ID NO: 3892 gagaacatacaagcaaagc | 10860 | 10879 | SEQ ID NO: | 5235 gcttggttttgccagtctc | 2467 | 2486 | 1 | 3 |
| SEQ ID NO: 3893 atggcaaatgtcagctctt | 10897 | 10916 | SEQ ID NO: | 5236 acgaggtatttaaagccat | 12960 | 12979 | 1 | 3 |
| SEQ ID NO: 3894 tggcaaatgtcagctcttg | 10898 | 10917 | SEQ ID NO: | 5237 caagaggtatttaaagcca | 12959 | 12978 | 1 | 3 |

TABLE 9-continued

Selected palindromic sequences from human ApoB

| Source | Start Index | End Index | Match | Index | Start Index | End # | | B |
|---|---|---|---|---|---|---|---|---|
| SEQ ID NO: 3895 ttgttcaggtccatgcaag | 10914 | 10933 | SEQ ID NO: 5238 cttgggggaggaggaacaa | 14066 | 14085 | 1 | | 3 |
| SEQ ID NO: 3896 tgttcaggtccatgcaagt | 10915 | 10934 | SEQ ID NO: 5239 acttgggggaggaggaaca | 14065 | 14084 | 1 | | 3 |
| SEQ ID NO: 3897 agttccttccatgatttcc | 10940 | 10959 | SEQ ID NO: 5240 ggaatctgatgaggaaact | 12256 | 12275 | 1 | | 3 |
| SEQ ID NO: 3898 tgctaacactaagaaccag | 10987 | 11006 | SEQ ID NO: 5241 ctggatgtaaccaccagca | 11186 | 11205 | 1 | | 3 |
| SEQ ID NO: 3899 actaagaaccagaagatca | 10994 | 11013 | SEQ ID NO: 5242 tgatcaagaacctgttagt | 13347 | 13366 | 1 | | 3 |
| SEQ ID NO: 3900 ctaagaaccagaagatcag | 10995 | 11014 | SEQ ID NO: 5243 ctgatcaagaacctgttag | 13346 | 13365 | 1 | | 3 |
| SEQ ID NO: 3901 cagaagatcagatggaaaa | 11003 | 11022 | SEQ ID NO: 5244 ttttcagaccaactctctg | 13622 | 13641 | 1 | | 3 |
| SEQ ID NO: 3902 aaaaatgaagtccggattc | 11018 | 11037 | SEQ ID NO: 5245 gaatttgaaagttcgtttt | 9280 | 9299 | 1 | | 3 |
| SEQ ID NO: 3903 gattcattctgggtctttc | 11032 | 11051 | SEQ ID NO: 5246 gaaaacctatgccttaatc | 13166 | 13185 | 1 | | 3 |
| SEQ ID NO: 3994 aagaaaaggcacaccttga | 11079 | 11098 | SEQ ID NO: 5247 tcaaaacctactgtctctt | 10466 | 10485 | 1 | | 3 |
| SEQ ID NO: 3905 aaggacacctaaggttcct | 11115 | 11134 | SEQ ID NO: 5248 aggacaccaaaataacctt | 7572 | 7591 | 1 | | 3 |
| SEQ ID NO: 3906 ccagcattggtaggagaca | 11199 | 11218 | SEQ ID NO: 5249 tgtcaacaagtaccactgg | 12370 | 12389 | 1 | | 3 |
| SEQ ID NO: 3907 ctttgtgtacaccaaaaac | 11239 | 11258 | SEQ ID NO: 5250 gttttttaaattgttgaaag | 13148 | 13167 | 1 | | 3 |
| SEQ ID NO: 3908 ccatccctgtaaaagtttt | 11277 | 11296 | SEQ ID NO: 5251 aaaagggtcatggaaatgg | 8893 | 8912 | 1 | | 3 |
| SEQ ID NO: 3909 tgatctaaattcagttctt | 11332 | 11351 | SEQ ID NO: 5252 aagatagtcagtctgatca | 13334 | 13353 | 1 | | 3 |
| SEQ ID NO: 3910 aagaagctgagaacttcat | 11432 | 11451 | SEQ ID NO: 5253 atgagatcaacacaatctt | 13110 | 13129 | 1 | | 3 |
| SEQ ID NO: 3911 tttgccctcaacctaccaa | 11453 | 11472 | SEQ ID NO: 5254 ttggtacgagttactcaaa | 12641 | 12660 | 1 | | 3 |
| SEQ ID NO: 3912 cttgattcccttttttgag | 11536 | 11555 | SEQ ID NO: 5255 ctcaattttgattttcaag | 8528 | 8547 | 1 | | 3 |
| SEQ ID NO: 3913 ttcacgcttccaaaagtg | 11591 | 11610 | SEQ ID NO: 5256 cactcattgattttctgaa | 12693 | 12712 | 1 | | 3 |
| SEQ ID NO: 3914 tgtttcagatggcattgct | 11608 | 11627 | SEQ ID NO: 5257 agcagattatgttgaaaca | 11833 | 11852 | 1 | | 3 |
| SEQ ID NO: 3915 aatgcagtagccaacaaga | 11639 | 11658 | SEQ ID NO: 5258 tcttttcagcccagccatt | 9231 | 9250 | 1 | | 3 |
| SEQ ID NO: 3916 ctgagcagaccattgagat | 11691 | 11710 | SEQ ID NO: 5259 atctgatgaggaaactcag | 12259 | 12278 | 1 | | 3 |
| SEQ ID NO: 3917 tgagcagaccattgagatt | 11692 | 11711 | SEQ ID NO: 5260 aatctgatgaggaaactca | 12258 | 12277 | 1 | | 3 |
| SEQ ID NO: 3918 ttgagattccctccattaa | 11703 | 11722 | SEQ ID NO: 5261 ttaatcttcataagttcaa | 13179 | 13198 | 1 | | 3 |
| SEQ ID NO: 3919 acttggagtgccagtttga | 11807 | 11826 | SEQ ID NO: 5262 tcaattgggagagacaagt | 6504 | 6523 | 1 | | 3 |
| SEQ ID NO: 3920 caaatttgaaggacttcag | 12004 | 12023 | SEQ ID NO: 5263 ctgagaacttcatcatttg | 11438 | 11457 | 1 | | 3 |
| SEQ ID NO: 3921 agcccagcgttcaccgatc | 12056 | 12075 | SEQ ID NO: 5264 gatccaagtatagttggct | 13286 | 13305 | 1 | | 3 |
| SEQ ID NO: 3922 cagcgttcaccgatctcca | 12060 | 12079 | SEQ ID NO: 5265 tggacctgcaccaaagctg | 13960 | 13979 | 1 | | 3 |
| SEQ ID NO: 3923 ctccatctgcgctaccaga | 12074 | 12093 | SEQ ID NO: 5266 tctgatatacatcacggag | 13711 | 13730 | 1 | | 3 |
| SEQ ID NO: 3924 atgaggaaactcagatcaa | 12264 | 12283 | SEQ ID NO: 5267 ttgagttgcccaccatcat | 11667 | 11686 | 1 | | 3 |
| SEQ ID NO: 3925 aggcagcttctggcttgct | 12300 | 12319 | SEQ ID NO: 5268 agcaagtctttcctggcct | 3018 | 3037 | 1 | | 3 |
| SEQ ID NO: 3926 tgaaagacaacgtgcccaa | 12327 | 12346 | SEQ ID NO: 5269 ttgggagagacaagtttca | 6608 | 6527 | 1 | | 3 |
| SEQ ID NO: 3927 tatgattatgtcaacaagt | 12362 | 12381 | SEQ ID NO: 5270 actttgcacactgttcata | 12763 | 12782 | 1 | | 3 |
| SEQ ID NO: 3928 cattaggcaaattgatgat | 12475 | 12494 | SEQ ID NO: 5271 atcaacacaatcttcaatg | 13115 | 13134 | 1 | | 3 |
| SEQ ID NO: 3929 ttgactcaggaaggccaag | 12584 | 12603 | SEQ ID NO: 5272 cttggtacgagttactcaa | 12640 | 12659 | 1 | | 3 |
| SEQ ID NO: 3930 gaaacctgggatatacact | 12736 | 12755 | SEQ ID NO: 5273 agtgattacacttcctttc | 12865 | 12884 | 1 | | 3 |
| SEQ ID NO: 3931 tcctttcgagttaaggaaa | 12877 | 12896 | SEQ ID NO: 5274 tttctgccactgctcagga | 13524 | 13543 | 1 | | 3 |

TABLE 9-continued

Selected palindromic sequences from human ApoB

| Source | Start Index | End Index | Match | Start Index | End Index | # | B |
|---|---|---|---|---|---|---|---|
| SEQ ID NO: 3932 gccattcagtctctcaaga | 12974 | 12993 | SEQ ID NO: 5275 tcttccgttctgtaatggc | 5802 | 5821 | 1 | 3 |
| SEQ ID NO: 3933 gtgctacgtaatcttcagg | 13001 | 13020 | SEQ ID NO: 5276 cctgcaccaaagctggcac | 13964 | 13983 | 1 | 3 |
| SEQ ID NO: 3934 agctgaaagagatgaaatt | 13065 | 13084 | SEQ ID NO: 5277 aatttattcaaaacgagct | 13200 | 13219 | 1 | 3 |
| SEQ ID NO: 3935 aatttacttatcttattaa | 13080 | 13099 | SEQ ID NO: 5278 ttaaaagaaatcttcaatt | 13815 | 13834 | 1 | 3 |
| SEQ ID NO: 3936 ttttaaattgttgaaagaa | 13150 | 13169 | SEQ ID NO: 5279 ttctctctatgggaaaaaa | 9566 | 9585 | 1 | 3 |
| SEQ ID NO: 3937 taatcttcataagttcaat | 13180 | 13199 | SEQ ID NO: 5280 attgagattccctccatta | 11702 | 11721 | 1 | 3 |
| SEQ ID NO: 3938 atattttgatccaagtata | 13279 | 13298 | SEQ ID NO: 5281 tataagcagaagcacatat | 13937 | 13956 | 1 | 3 |
| SEQ ID NO: 3939 tgaaatattatgaacttga | 13311 | 13330 | SEQ ID NO: 5282 tcaaccttaatgattttca | 8295 | 8314 | 1 | 3 |
| SEQ ID NO: 3940 caatttctgcacagaaata | 13442 | 13461 | SEQ ID NO: 5283 tattcttcttttccaattg | 13834 | 13853 | 1 | 3 |
| SEQ ID NO: 3941 agaagattgcagagctttc | 13509 | 13528 | SEQ ID NO: 5284 gaaatcttcaatttattct | 13821 | 13840 | 1 | 3 |
| SEQ ID NO: 3942 gaagaaaataatttctgat | 13570 | 13589 | SEQ ID NO: 5285 atcagttcagataaacttc | 7999 | 8018 | 1 | 3 |
| SEQ ID NO: 3943 ttgacctgtccattcaaaa | 13680 | 13699 | SEQ ID NO: 5286 ttttgagaatgaatttcaa | 10422 | 10441 | 1 | 3 |
| SEQ ID NO: 3944 tcaaaactaccacacattt | 13693 | 13712 | SEQ ID NO: 5287 aaattccttgacatgttga | 7370 | 7389 | 1 | 3 |
| SEQ ID NO: 3945 ttttttaaaagaaatcttc | 13811 | 13830 | SEQ ID NO: 5288 gaagtgtcagtggcaaaaa | 10382 | 10401 | 1 | 3 |
| SEQ ID NO: 3946 aggatctgcgttattttgc | 14043 | 14062 | SEQ ID NO: 5289 gcaagggttcactgttcct | 7864 | 7883 | 1 | 3 |
| SEQ ID NO: 3947 tttgctaaacttgggggag | 14057 | 14076 | SEQ ID NO: 5290 ctccccaggaccttcaa | 9842 | 9861 | 1 | 3 |

TABLE 10

Selected palindromic sequences from human glucose-6-phosphatase

| Source | Start Index | End Index | Match | Start Index | End Index | # | B |
|---|---|---|---|---|---|---|---|
| SEQ ID NO: 5291 tccatcttcaggaagctgt | 222 | 241 | SEQ ID NO: 5369 acagactctttcagatgga | 1340 | 1359 | 1 | 6 |
| SEQ ID NO: 5292 ccatcttcaggaagctgtg | 223 | 242 | SEQ ID NO: 5370 cacagactctttcagatgg | 1339 | 1358 | 1 | 6 |
| SEQ ID NO: 5293 cctctggccatgccatggg | 417 | 436 | SEQ ID NO: 5371 cccattttgaggccagagg | 1492 | 1511 | 1 | 6 |
| SEQ ID NO: 5294 ctctggccatgccatgggc | 418 | 437 | SEQ ID NO: 5372 gcccattttgaggccagag | 1491 | 1510 | 1 | 6 |
| SEQ ID NO: 5295 ttgaatgtcattttgtggt | 521 | 540 | SEQ ID NO: 5373 accatacattatcattcaa | 2945 | 2964 | 1 | 6 |
| SEQ ID NO: 5296 tcagtaatgggggaccagc | 1886 | 1905 | SEQ ID NO: 5374 gctggtctcgaactcctga | 2731 | 2750 | 1 | 6 |
| SEQ ID NO: 5297 ttttactgtgcatacatgt | 1956 | 1975 | SEQ ID NO: 5375 acatctttgaaaagaaaaa | 2983 | 3002 | 1 | 6 |
| SEQ ID NO: 5298 tgaggtgccaaggaaatga | 50 | 69 | SEQ ID NO: 5376 tcatgtctcagcctcctca | 2620 | 2639 | 1 | 5 |
| SEQ ID NO: 5299 gaggtgccaaggaaatgag | 51 | 70 | SEQ ID NO: 5377 ctcatgtctcagcctcctc | 2619 | 2638 | 1 | 5 |
| SEQ ID NO: 5300 gggaaagataaagccgacc | 487 | 506 | SEQ ID NO: 5378 ggtcgcctggcttattccc | 1295 | 1314 | 1 | 5 |
| SEQ ID NO: 5301 ttttcctcatcaagttgtt | 598 | 617 | SEQ ID NO: 5379 aacatctttgaaaagaaaa | 2982 | 3001 | 1 | 5 |
| SEQ ID NO: 5302 ctttcagccacatccacag | 651 | 670 | SEQ ID NO: 5380 ctgtggactctggagaaag | 773 | 792 | 1 | 5 |
| SEQ ID NO: 5303 tggactctggagaaagccc | 776 | 795 | SEQ ID NO: 5381 gggctggctctcaactcca | 884 | 903 | 1 | 5 |
| SEQ ID NO: 5304 agcctcctcaagaacctgg | 848 | 867 | SEQ ID NO: 5382 ccagattcttccactggct | 2107 | 2126 | 1 | 5 |
| SEQ ID NO: 5305 ggcctggggctggctctca | 878 | 897 | SEQ ID NO: 5383 tgagccaccgcacgggcc | 2801 | 2820 | 1 | 5 |
| SEQ ID NO: 5306 gagctcactcccactggaa | 1439 | 1458 | SEQ ID NO: 5384 ttccaggtagggccagctc | 1676 | 1695 | 1 | 5 |

TABLE 10-continued

Selected palindromic sequences from human glucose-6-phosphatase

| Source | | Start Index | End Index | Match | | Start Index | End Index | # | B |
|---|---|---|---|---|---|---|---|---|---|
| SEQ ID NO: 5307 | agctaatgaagctattgag | 1572 | 1591 | SEQ ID NO: 5385 | ctcagcctcctcagtagct | 2626 | 2645 | 1 | 5 |
| SEQ ID NO: 5308 | gctaatgaagctattgaga | 1573 | 1592 | SEQ ID NO: 5386 | tctcagcctcctcagtagc | 2625 | 2644 | 1 | 5 |
| SEQ ID NO: 5309 | ctaaatggctttaattata | 1854 | 1873 | SEQ ID NO: 5387 | tatatttttagaattttag | 2683 | 2702 | 1 | 5 |
| SEQ ID NO: 5310 | ctgcttttctttttttttc | 2509 | 2528 | SEQ ID NO: 5388 | gaaaaatatatatgtgcag | 2996 | 3015 | 1 | 5 |
| SEQ ID NO: 5311 | caatcaccaccaagcctgg | 0 | 19 | SEQ ID NO: 5389 | ccagaatgggtccacattg | 812 | 831 | 1 | 4 |
| SEQ ID NO: 5312 | agcctggaataactgcaag | 12 | 31 | SEQ ID NO: 5390 | cttggatttctgaatggct | 1987 | 2006 | 1 | 4 |
| SEQ ID NO: 5313 | gttccatcttcaggaagct | 220 | 239 | SEQ ID NO: 5391 | agctcactcccactggaac | 1440 | 1459 | 1 | 4 |
| SEQ ID NO: 5314 | tggtgggttttggatactg | 326 | 345 | SEQ ID NO: 5392 | cagtcctcccaccctacca | 2425 | 2444 | 1 | 4 |
| SEQ ID NO: 5315 | acctgtgagactggaccag | 392 | 411 | SEQ ID NO: 5393 | ctggagaaagcccagaggt | 782 | 801 | 1 | 4 |
| SEQ ID NO: 5316 | gctgttacagaaactttca | 638 | 657 | SEQ ID NO: 5394 | tgaatggtcttctgccagc | 1474 | 1493 | 1 | 4 |
| SEQ ID NO: 5317 | acagcatctataatgccag | 666 | 685 | SEQ ID NO: 5395 | ctgggtgtagacctcctgt | 758 | 777 | 1 | 4 |
| SEQ ID NO: 5318 | gggtgtagacctcctgtgg | 760 | 779 | SEQ ID NO: 5396 | ccacattgacaccacaccc | 823 | 842 | 1 | 4 |
| SEQ ID NO: 5319 | ggtgtagacctcctgtgga | 761 | 780 | SEQ ID NO: 5397 | tccacattgacaccacacc | 822 | 841 | 1 | 4 |
| SEQ ID NO: 5320 | gtgtagacctcctgtggac | 762 | 781 | SEQ ID NO: 5398 | gtccacattgacaccacac | 821 | 840 | 1 | 4 |
| SEQ ID NO: 5321 | gacctcctgtggactctgg | 767 | 786 | SEQ ID NO: 5399 | ccagatattgcactaggtc | 2014 | 2033 | 1 | 4 |
| SEQ ID NO: 5322 | cctgggcacgctctttggc | 862 | 881 | SEQ ID NO: 5400 | gccagctcacaagcccagg | 1687 | 1706 | 1 | 4 |
| SEQ ID NO: 5323 | ctgggcacgctctttggcc | 863 | 882 | SEQ ID NO: 5401 | ggccagctcacaagcccag | 1686 | 1705 | 1 | 4 |
| SEQ ID NO: 5324 | ctggtcttctacgtcttgt | 1028 | 1047 | SEQ ID NO: 5402 | acaaaagcaagacttccag | 1663 | 1682 | 1 | 4 |
| SEQ ID NO: 5325 | agagtgcggtagtgccct | 1056 | 1075 | SEQ ID NO: 5403 | agggccaggattcctctct | 2229 | 2248 | 1 | 4 |
| SEQ ID NO: 5326 | tgggcactggtatttggag | 1217 | 1236 | SEQ ID NO: 5404 | ctcccactggaacagccca | 1446 | 1465 | 1 | 4 |
| SEQ ID NO: 5327 | gaattaaatcacggatggc | 1267 | 1286 | SEQ ID NO: 5405 | gccaaccaagagcacattc | 2311 | 2330 | 1 | 4 |
| SEQ ID NO: 5328 | tgttgctagaagttgggtt | 1598 | 1617 | SEQ ID NO: 5406 | aaccatcctgctcataaca | 2967 | 2986 | 1 | 4 |
| SEQ ID NO: 5329 | aggagctctgaatctgata | 1764 | 1783 | SEQ ID NO: 5407 | tatcacattacatcatcct | 2063 | 2082 | 1 | 4 |
| SEQ ID NO: 5330 | taaatggctttaattatat | 1855 | 1874 | SEQ ID NO: 5408 | atatatgtgcagtattttta | 3003 | 3022 | 1 | 4 |
| SEQ ID NO: 5331 | aaaatgacaaggggagggc | 2215 | 2234 | SEQ ID NO: 5409 | gccctccttgcctgttttt | 2817 | 2836 | 1 | 4 |
| SEQ ID NO: 5332 | ttaaaggaaaagtcaacat | 2330 | 2349 | SEQ ID NO: 5410 | atgtgcagtattttattaa | 3007 | 3026 | 1 | 4 |
| SEQ ID NO: 5333 | acatcttctctcttttttt | 2345 | 2364 | SEQ ID NO: 5411 | aaaagaaaaatatatatgt | 2992 | 3011 | 1 | 4 |
| SEQ ID NO: 5334 | ttctacgtcctcttcccca | 197 | 216 | SEQ ID NO: 5412 | tgggccagccgcacaagaa | 1116 | 1135 | 1 | 3 |
| SEQ ID NO: 5335 | tgggtagctgtgattggag | 257 | 276 | SEQ ID NO: 5413 | ctcccactggaacagccca | 1446 | 1465 | 1 | 3 |
| SEQ ID NO: 5336 | gctgtgattggagactggc | 263 | 282 | SEQ ID NO: 5414 | gccatgccatgggcacagc | 423 | 442 | 1 | 3 |
| SEQ ID NO: 5337 | cacttccgtgccctgata | 358 | 377 | SEQ ID NO: 5415 | tatcacccaggctggagtg | 2548 | 2567 | 1 | 3 |
| SEQ ID NO: 5338 | acatctactctttccatct | 464 | 483 | SEQ ID NO: 5416 | agatgggatttcatcatgt | 2705 | 2724 | 1 | 3 |
| SEQ ID NO: 5339 | ctactcttttccatctttca | 468 | 487 | SEQ ID NO: 5417 | tgaatactctcacaagtag | 1419 | 1438 | 1 | 3 |
| SEQ ID NO: 5340 | agataaagccgacctacag | 492 | 511 | SEQ ID NO: 5418 | ctgttttcaatctcatct | 2828 | 2847 | 1 | 3 |
| SEQ ID NO: 5341 | tgtgcagctgaatgtctgt | 553 | 572 | SEQ ID NO: 5419 | acagaaactttcagccaca | 644 | 663 | 1 | 3 |
| SEQ ID NO: 5342 | atgtctgtctgtcacgaat | 564 | 583 | SEQ ID NO: 5420 | attcaggtatagctgacat | 2038 | 2057 | 1 | 3 |
| SEQ ID NO: 5343 | ctgtcacgaatctaccttg | 572 | 591 | SEQ ID NO: 5421 | caaggtgctaggattacag | 2779 | 2798 | 1 | 3 |

TABLE 10-continued

Selected palindromic sequences from human glucose-6-phosphatase

| Source | | Start Index | End Index | Match | | Start Index | End Index | # | B |
|---|---|---|---|---|---|---|---|---|---|
| SEQ ID NO: 5344 | atcaagttgttgctggagt | 606 | 625 | SEQ ID NO: 5422 | actcctgacctcaagtgat | 2742 | 2761 | 1 | 3 |
| SEQ ID NO: 5345 | cagaaactttcagccacat | 645 | 664 | SEQ ID NO: 5423 | atgtttcaattaggctctg | 2185 | 2204 | 1 | 3 |
| SEQ ID NO: 5346 | actttcagccacatccaca | 650 | 669 | SEQ ID NO: 5424 | tgtggcgtatcatgcaagt | 1818 | 1837 | 1 | 3 |
| SEQ ID NO: 5347 | atgccagcctcaagaaata | 678 | 697 | SEQ ID NO: 5425 | tattttttttactgtgcat | 1950 | 1969 | 1 | 3 |
| SEQ ID NO: 5348 | agaaatattttctcattac | 690 | 709 | SEQ ID NO: 5426 | gtaaatatgactcctttct | 2283 | 2302 | 1 | 3 |
| SEQ ID NO: 5349 | gaaatattttctcattacc | 691 | 710 | SEQ ID NO: 5427 | ggtaaatatgactcctttc | 2282 | 2301 | 1 | 3 |
| SEQ ID NO: 5350 | tgctgctcaagggactggg | 744 | 763 | SEQ ID NO: 5428 | cccaagccaaccaagagca | 2306 | 2325 | 1 | 3 |
| SEQ ID NO: 5351 | cctgtggactctggagaaa | 772 | 791 | SEQ ID NO: 5429 | tttcatcatgttggccagg | 2713 | 2732 | 1 | 3 |
| SEQ ID NO: 5352 | ggagaaagcccagaggtgg | 784 | 803 | SEQ ID NO: 5430 | ccaccgcaccgggccctcc | 2805 | 2824 | 1 | 3 |
| SEQ ID NO: 5353 | ttgaaaccccatcccaag | 1004 | 1023 | SEQ ID NO: 5431 | cttgaattcctgggctcaa | 2405 | 2424 | 1 | 3 |
| SEQ ID NO: 5354 | cagatggaggtgccatatc | 1351 | 1370 | SEQ ID NO: 5432 | gatatgcagagtatttctg | 2847 | 2866 | 1 | 3 |
| SEQ ID NO: 5355 | ggagctcactcccactgga | 1438 | 1457 | SEQ ID NO: 5433 | tccacctgccttggcctcc | 2760 | 2779 | 1 | 3 |
| SEQ ID NO: 5356 | ttgggtaatgtttttgaaa | 1553 | 1572 | SEQ ID NO: 5434 | tttctctatcccaagccaa | 2297 | 2316 | 1 | 3 |
| SEQ ID NO: 5357 | gaagttgggttgttctgga | 1606 | 1625 | SE0 ID NO: 5435 | tccaccccactggatcttc | 2131 | 2150 | 1 | 3 |
| SEQ ID NO: 5358 | aaagaaggctgcctaagg | 1785 | 1804 | SEQ ID NO: 5436 | ccttgcctgcttttctttt | 2503 | 2522 | 1 | 3 |
| SEQ ID NO: 5359 | aaagaaggctgcctaagga | 1786 | 1805 | SEQ ID NO: 5437 | tccttgcctgcttttcttt | 2502 | 2521 | 1 | 3 |
| SEQ ID NO: 5360 | aagaaggctgcctaaggag | 1787 | 1806 | SEQ ID NO: 5438 | ctccttgcctgcttttctt | 2501 | 2520 | 1 | 3 |
| SEQ ID NO: 5361 | agaaggctgcctaaggagg | 1788 | 1807 | SEQ ID NO: 5439 | cctccttgcctgcttttct | 2500 | 2519 | 1 | 3 |
| SEQ ID NO: 5362 | atttccttggatttctgaa | 1982 | 2001 | SEQ ID NO: 5440 | ttcaattaggctctgaaat | 2189 | 2208 | 1 | 3 |
| SEQ ID NO: 5363 | tccttataagcccagctct | 2081 | 2100 | SEQ ID NO: 5441 | agagcacattcttaaagga | 2319 | 2338 | 1 | 3 |
| SEQ ID NO: 5364 | ataagcccagctctgcttt | 2086 | 2105 | SEQ ID NO: 5442 | aaagctgaagcctatttat | 2889 | 2908 | 1 | 3 |
| SEQ ID NO: 5365 | ggccaggattcctctctca | 2231 | 2250 | SEQ ID NO: 5443 | tgagccaccgcaccgggcc | 2801 | 2820 | 1 | 3 |
| SEQ ID NO: 5366 | gccaactcctccttgcctg | 2493 | 2512 | SEQ ID NO: 5444 | caggctggagtggagtggc | 2555 | 2574 | 1 | 3 |
| SEQ ID NO: 5367 | tttttttctttttttgag | 2519 | 2538 | SEQ ID NO: 5445 | ctcataacatctttgaaaa | 2977 | 2996 | 1 | 3 |
| SEQ ID NO: 5368 | ccggcgtgcaccaccatgc | 2652 | 2671 | SEQ ID NO: 5446 | gcatgagccaccgcaccgg | 2798 | 2817 | 1 | 3 |

TABLE 11

Selected palindromic sequences from rat glucose-6-phosphatase

| Source | | Start Index | End Index | Match | | Start Index | End Index | # | B |
|---|---|---|---|---|---|---|---|---|---|
| SEQ ID NO: 5447 | ctgactattacagcaacag | 301 | 320 | SEQ ID NO: 5471 | ctgtggctgaaactttcag | 598 | 617 | 1 | 6 |
| SEQ ID NO: 5448 | ctcttggggttgggctgg | 831 | 850 | SEQ ID NO: 5472 | ccagcatgtaccgcaagag | 859 | 878 | 1 | 6 |
| SEQ ID NO: 5449 | tgcaaaggagaactgcgca | 879 | 898 | SEQ ID NO: 5473 | tgcgaccgtcccctttgca | 1019 | 1038 | 1 | 6 |
| SEQ ID NO: 5450 | cctcgggccatgccatggg | 376 | 395 | SEQ ID NO: 5474 | cccagtgtggggccagagg | 1171 | 1190 | 1 | 5 |
| SEQ ID NO: 5451 | ttgagcaaaccatatgcaa | 1478 | 1497 | SEQ ID NO: 5475 | ttgcagagtgtgtcttcaa | 2057 | 2076 | 1 | 5 |
| SEQ ID NO: 5452 | cagcttcctgaggtaccaa | 2 | 21 | SEQ ID NO: 5476 | ttggtgtctgtgatcgctg | 123 | 142 | 1 | 4 |
| SEQ ID NO: 5453 | ggtaccaaggaggaaggat | 13 | 32 | SEQ ID NO: 5477 | atccagtcgactcgctacc | 66 | 85 | 1 | 4 |

TABLE 11-continued

Selected palindromic sequences from rat glucose-6-phosphatase

| Source | | Start Index | End Index | Match | | Start Index | End Index | # | B |
|---|---|---|---|---|---|---|---|---|---|
| SEQ ID NO: 5454 | ctccacgactttgggatcc | 51 | 70 | SEQ ID NO: 5478 | ggatcgggaggagggggag | 1448 | 1467 | 1 | 4 |
| SEQ ID NO: 5455 | caggactggtttgtcttgg | 108 | 127 | SEQ ID NO: 5479 | ccaagcccgactgtgcctg | 2018 | 2037 | 1 | 4 |
| SEQ ID NO: 5456 | cttctatgtcctctttccc | 155 | 174 | SEQ ID NO: 5480 | gggacagacacacaagaag | 1076 | 1095 | 1 | 4 |
| SEQ ID NO: 5457 | ttctatgtcctctttccca | 156 | 175 | SEQ ID NO: 5481 | tgggacagacacacaagaa | 1075 | 1094 | 1 | 4 |
| SEQ ID NO: 5458 | tggttccacattcaagaga | 177 | 196 | SEQ ID NO: 5482 | tctcaataatgatagacca | 1549 | 1568 | 1 | 4 |
| SEQ ID NO: 5459 | tgcctctgataaaacagtt | 325 | 344 | SEQ ID NO: 5483 | aactctgagatcttgggca | 1868 | 1887 | 1 | 4 |
| SEQ ID NO: 5460 | agcccggctcctgggacag | 1064 | 1083 | SEQ ID NO: 5484 | ctgtcctccagcctgggct | 2034 | 2053 | 1 | 4 |
| SEQ ID NO: 5461 | agtctctgacacaagtcag | 1111 | 1130 | SEQ ID NO: 5485 | ctgaatggtaatggtgact | 1659 | 1678 | 1 | 4 |
| SEQ ID NO: 5462 | aaaaaggtgaattttaaa | 1237 | 1256 | SEQ ID NO: 5486 | tttattaaaacgacatttt | 2201 | 2220 | 1 | 4 |
| SEQ ID NO: 5463 | acactctcaataatgatag | 1545 | 1564 | SEQ ID NO: 5487 | ctatgaatgatgcctgtgt | 2121 | 2140 | 1 | 4 |
| SEQ ID NO: 5464 | aaagaatgaacgtgctcca | 37 | 56 | SEQ ID NO: 5488 | tggacctcctgtggacttt | 724 | 743 | 1 | 3 |
| SEQ ID NO: 5465 | ctttgggatccagtcgact | 59 | 78 | SEQ ID NO: 5489 | agtcagcggccgtgcaaag | 1124 | 1143 | 1 | 3 |
| SEQ ID NO: 5466 | gtgatcgctgacctcagga | 132 | 151 | SEQ ID NO: 5490 | tcctctctccaaaggtcac | 1911 | 1930 | 1 | 3 |
| SEQ ID NO: 5467 | ggaacgccttctatgtcct | 148 | 167 | SEQ ID NO: 5491 | aggactcatcactgcttcc | 1748 | 1767 | 1 | 3 |
| SEQ ID NO: 5468 | gactgtgggcatcaatctc | 194 | 213 | SEQ ID NO: 5492 | gagactggaccagggagtc | 357 | 376 | 1 | 3 |
| SEQ ID NO: 5469 | ggacactgactattacagc | 296 | 315 | SEQ ID NO: 5493 | gctgaacgtctgtctgtcc | 518 | 537 | 1 | 3 |
| SEQ ID NO: 5470 | aagcccccgtcccagattg | 966 | 985 | SEQ ID NO: 5494 | caattgtttgctggtgctt | 1833 | 1852 | 1 | 3 |

TABLE 12

Selected palindromic sequences from human B-catenin

| Source | | Start Index | End Index | Match | | Start Index | End Index | # | B |
|---|---|---|---|---|---|---|---|---|---|
| SEQ ID NO: 5495 | agcagcttcagtccccgcc | 70 | 89 | SEQ ID NO: 5542 | ggcgacatatgcagctgct | 2152 | 2171 | 1 | 5 |
| SEQ ID NO: 5496 | ccattctggtgccactacc | 304 | 323 | SEQ ID NO: 5543 | ggtatggaccccatgatgg | 2387 | 2406 | 1 | 5 |
| SEQ ID NO: 5497 | tccttctctgagtggtaaa | 328 | 347 | SEQ ID NO: 5544 | tttattacatcaagaagga | 985 | 1004 | 1 | 5 |
| SEQ ID NO: 5498 | tctgagtggtaaaggcaat | 334 | 353 | SEQ ID NO: 5545 | attgtacgtaccatgcaga | 791 | 810 | 1 | 5 |
| SEQ ID NO: 5499 | cagagggtacgagctgcta | 473 | 492 | SEQ ID NO: 5546 | tagctgcaggggtcctctg | 2037 | 2056 | 1 | 5 |
| SEQ ID NO: 5500 | ctaaatgacgaggaccagg | 677 | 696 | SEQ ID NO: 5547 | cctgtaaatcatcctttag | 2539 | 2558 | 1 | 5 |
| SEQ ID NO: 5501 | taaatgacgaggaccaggt | 678 | 697 | SEQ ID NO: 5548 | acctgtaaatcatccttta | 2538 | 2557 | 1 | 5 |
| SEQ ID NO: 5502 | gtcctgtatgagtgggaac | 383 | 402 | SEQ ID NO: 5549 | gttccgaatgtctgaggac | 2176 | 2195 | 2 | 4 |
| SEQ ID NO: 5503 | cccagcgccgtacgtccat | 1839 | 1858 | SEQ ID NO: 5550 | atgggctgccagatctggg | 2451 | 2470 | 2 | 4 |
| SEQ ID NO: 5504 | tcccctgagggtatttgaa | 143 | 162 | SEQ ID NO: 5551 | ttcacatcctagctcggga | 1929 | 1948 | 1 | 4 |
| SEQ ID NO: 5505 | gggtatttgaagtatacca | 151 | 170 | SEQ ID NO: 5552 | tggttaagctcttacaccc | 1680 | 1699 | 1 | 4 |
| SEQ ID NO: 5506 | gctgttagtcactggcagc | 260 | 279 | SEQ ID NO: 5553 | gctgcctccaggtgacagc | 2494 | 2513 | 1 | 4 |
| SEQ ID NO: 5507 | gtcctgtatgagtgggaac | 383 | 402 | SEQ ID NO: 5554 | gttcgccttcactatggac | 1652 | 1671 | 1 | 4 |
| SEQ ID NO: 5508 | tcctgtatgagtgggaaca | 384 | 403 | SEQ ID NO: 5555 | tgttccgaatgtctgagga | 2175 | 2194 | 1 | 4 |
| SEQ ID NO: 5509 | gtatgcaatgactcgagct | 454 | 473 | SEQ ID NO: 5556 | agctggcctggtttgatac | 2517 | 2536 | 1 | 4 |

TABLE 12-continued

Selected palindromic sequences from human B-catenin

| Source | | Start Index | End Index | Match | | Start Index | End Index | # | B |
|---|---|---|---|---|---|---|---|---|---|
| SEQ ID NO: 5510 | gtccagcgtttggctgaac | 563 | 582 | SEQ ID NO: 5557 | gttcgccttcactatggac | 1652 | 1671 | 1 | 4 |
| SEQ ID NO: 5511 | tatcaagatgatgcagaac | 623 | 642 | SEQ ID NO: 5558 | gttcgtgcacatcaggata | 1820 | 1839 | 1 | 4 |
| SEQ ID NO: 5512 | tatggtccatcagctttct | 718 | 737 | SEQ ID NO: 5559 | agaaagcaagctcatcata | 1126 | 1145 | 1 | 4 |
| SEQ ID NO: 5513 | ccctggtgaaaatgcttgg | 915 | 934 | SEQ ID NO: 5560 | ccaaagagtagctgcaggg | 2029 | 2048 | 1 | 4 |
| SEQ ID NO: 5514 | agctttaggacttcacctg | 1291 | 1310 | SEQ ID NO: 5561 | caggtgacagcaatcagct | 2502 | 2521 | 1 | 4 |
| SEQ ID NO: 5515 | ggaatctttcagatgctgc | 1356 | 1375 | SEQ ID NO: 5562 | gcagctgctgttttgttcc | 2162 | 2181 | 1 | 4 |
| SEQ ID NO: 5516 | tgtccttcgggctggtgac | 1549 | 1568 | SEQ ID NO: 5563 | gtcatctgaccagccaca | 1605 | 1624 | 1 | 4 |
| SEQ ID NO: 5517 | cacagctcctctgacagag | 2107 | 2126 | SEQ ID NO: 5564 | ctctaggaatgaaggtgtg | 2134 | 2153 | 1 | 4 |
| SEQ ID NO: 5518 | ccagacagaaaagcggctg | 245 | 264 | SEQ ID NO: 5565 | cagctcgttgtaccgctgg | 828 | 847 | 2 | 3 |
| SEQ ID NO: 5519 | cagcagcgttggcccggcc | 4 | 23 | SEQ ID NO: 5566 | ggccaccaccctggtgctg | 2420 | 2439 | 1 | 3 |
| SEQ ID NO: 5520 | aggtctgaggagcagcttc | 60 | 79 | SEQ ID NO: 5567 | gaagaggatgtggatacct | 359 | 378 | 1 | 3 |
| SEQ ID NO: 5521 | actgttttgaaaatccagc | 174 | 193 | SEQ ID NO: 5568 | gctgatattgatggacagt | 437 | 456 | 1 | 3 |
| SEQ ID NO: 5522 | ctgatttgatggagttgga | 213 | 232 | SEQ ID NO: 5569 | tccaggtgacagcaatcag | 2500 | 2519 | 1 | 3 |
| SEQ ID NO: 5523 | ccagacagaaaagcggctg | 245 | 264 | SEQ ID NO: 5570 | cagcaacagtcttacctgg | 275 | 294 | 1 | 3 |
| SEQ ID NO: 5524 | acagctccttctctgagtg | 323 | 342 | SEQ ID NO: 5571 | cactgagcctgccatctgt | 1579 | 1598 | 1 | 3 |
| SEQ ID NO: 5525 | tggatacctcccaagtcct | 369 | 388 | SEQ ID NO: 5572 | aggactaaataccattcca | 1972 | 1991 | 1 | 3 |
| SEQ ID NO: 5526 | tcaagaacaagtagctgat | 424 | 443 | SEQ ID NO: 5573 | atcagctggcctggtttga | 2514 | 2533 | 1 | 3 |
| SEQ ID NO: 5527 | agctcagagggtacgagct | 469 | 488 | SEQ ID NO: 5574 | agctggtggaatgcaagct | 1276 | 1295 | 1 | 3 |
| SEQ ID NO: 5528 | gcatgcagatcccatctac | 516 | 535 | SEQ ID NO: 5575 | gtagaagctggtggaatgc | 1271 | 1290 | 1 | 3 |
| SEQ ID NO: 5529 | ccacacgtgcaatccctga | 645 | 664 | SEQ ID NO: 5576 | tcagatgatataaatgtgg | 1430 | 1449 | 1 | 3 |
| SEQ ID NO: 5530 | cacacgtgcaatccctgaa | 646 | 665 | SEQ ID NO: 5577 | ttcagatgatataaatgtg | 1429 | 1448 | 1 | 3 |
| SEQ ID NO: 5531 | ggaccttgcataacctttc | 846 | 865 | SEQ ID NO: 5578 | gaaatcttgccctttgtcc | 1743 | 1762 | 1 | 3 |
| SEQ ID NO: 5532 | ctccacaacctttattac | 974 | 993 | SEQ ID NO: 5579 | gtaaatcatcctttaggag | 2542 | 2561 | 1 | 3 |
| SEQ ID NO: 5533 | cagagtgctgaaggtgcta | 1222 | 1241 | SEQ ID NO: 5580 | tagctgcaggggtcctctg | 2037 | 2056 | 1 | 3 |
| SEQ ID NO: 5534 | ggactctcaggaatctttc | 1347 | 1366 | SEQ ID NO: 5581 | gaaatcttgccctttgtcc | 1743 | 1762 | 1 | 3 |
| SEQ ID NO: 5535 | tgatataaatgtggtcacc | 1435 | 1454 | SEQ ID NO: 5582 | ggtgacagggaagacatca | 1562 | 1581 | 1 | 3 |
| SEQ ID NO: 5536 | cccagcgccgtacgtccat | 1839 | 1858 | SEQ ID NO: 5583 | atggccaggatgccttggg | 2370 | 2389 | 1 | 3 |
| SEQ ID NO: 5537 | gtccatgggtgggacacag | 1852 | 1871 | SEQ ID NO: 5584 | ctgtgaacttgctcaggac | 2053 | 2072 | 1 | 3 |
| SEQ ID NO: 5538 | ttgtaccggagcccttcac | 1915 | 1934 | SEQ ID NO: 5585 | gtgaacttgctcaggacaa | 2055 | 2074 | 1 | 3 |
| SEQ ID NO: 5539 | ttgttatcagagagactaaa | 1962 | 1981 | SEQ ID NO: 5586 | tttaggagtaacaatacaa | 2553 | 2572 | 1 | 3 |
| SEQ ID NO: 5540 | gaagctattgaagctgagg | 2084 | 2103 | SEQ ID NO: 5587 | cctctgacagagttacttc | 2114 | 2133 | 1 | 3 |
| SEQ ID NO: 5541 | tcagaacagagccaatggc | 2247 | 2266 | SEQ ID NO: 5588 | gccaccaccctggtgctga | 2421 | 2440 | 1 | 3 |

TABLE 13

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5589 | cagcacctgggtgctggta | 5314 | 5333 | SEQ ID NO: 6135 | taccatcacccagctgctg | 6196 | 6215 | 1 | 9 |
| SEQ ID NO: 5590 | aactcgtccggatgcccgg | 1682 | 1701 | SEQ ID NO: 6136 | ccgggcagcgggtcgagtt | 8202 | 8221 | 1 | 8 |
| SEQ ID NO: 5591 | cgctgctgggtagcgctca | 1049 | 1068 | SEQ ID NO: 6137 | tgagagcgacgccgcagcg | 6151 | 6170 | 1 | 7 |
| SEQ ID NO: 5592 | ctccggatcccacaagccg | 1352 | 1371 | SEQ ID NO: 6138 | cggcatgtgggcccgggag | 6053 | 6072 | 1 | 7 |
| SEQ ID NO: 5593 | tgtaacatcggggggtcg | 2048 | 2067 | SEQ ID NO: 6139 | cgaccctcccacattaca | 6871 | 6890 | 1 | 7 |
| SEQ ID NO: 5594 | gtaacatcggggggtcgg | 2049 | 2068 | SEQ ID NO: 6140 | ccgaccctcccacattac | 6870 | 6889 | 1 | 7 |
| SEQ ID NO: 5595 | cagccaccaagcaggcgga | 5556 | 5575 | SEQ ID NO: 6141 | tccggctggttcgttgctg | 9254 | 9273 | 1 | 7 |
| SEQ ID NO: 5596 | ctcaccacccagaacaccc | 5744 | 5763 | SEQ ID NO: 6142 | gggtgtgcacggtgttgag | 6291 | 6310 | 1 | 7 |
| SEQ ID NO: 5597 | ccagccttaccatcaccca | 6189 | 6208 | SEQ ID NO: 6143 | tgggcgctggtatcgctgg | 5832 | 5851 | 1 | 7 |
| SEQ ID NO: 5598 | ctacgccgtgttccggctc | 6249 | 6268 | SEQ ID NO: 6144 | gagcccgaaccggacgtag | 6830 | 6849 | 1 | 7 |
| SEQ ID NO: 5599 | tacgccgtgttccggctcg | 6250 | 6269 | SEQ ID NO: 6145 | cgagcccgaaccggacgta | 6829 | 6848 | 1 | 7 |
| SEQ ID NO: 5600 | gagttcctggtaaaagcct | 8216 | 8235 | SEQ ID NO: 6146 | aggctatgactaggtactc | 8634 | 8653 | 1 | 7 |
| SEQ ID NO: 5601 | atggcggggaactgggcta | 1430 | 1449 | SEQ ID NO: 6147 | tagcgcattttcactccat | 9019 | 9038 | 2 | 6 |
| SEQ ID NO: 5602 | aaccaaacgtaacaccaac | 370 | 389 | SEQ ID NO: 6148 | gttgccgctaccttaggtt | 4115 | 4134 | 1 | 6 |
| SEQ ID NO: 5603 | ggtggtcagatcgttggtg | 419 | 438 | SEQ ID NO: 6149 | caccagcccgctcaccacc | 5734 | 5753 | 1 | 6 |
| SEQ ID NO: 5604 | ccttggccctctatggca | 584 | 603 | SEQ ID NO: 6150 | tgccaacgtgggtacaagg | 6374 | 6393 | 1 | 6 |
| SEQ ID NO: 5605 | taccccggccacgcgtcag | 1265 | 1284 | SEQ ID NO: 6151 | ctgacgactagctgcggta | 8465 | 8484 | 1 | 6 |
| SEQ ID NO: 5606 | gggcacgctgccgcctca | 1508 | 1527 | SEQ ID NO: 6152 | tgagacgacgaccgtgccc | 4759 | 4778 | 1 | 6 |
| SEQ ID NO: 5607 | ctgcaatgactccctccag | 1624 | 1643 | SEQ ID NO: 6153 | ctggtggccctcaatgcag | 2594 | 2613 | 1 | 6 |
| SEQ ID NO: 5608 | aaccgatcgtctcggcaac | 1897 | 1916 | SEQ ID NO: 6154 | gttgccgctaccttaggtt | 4115 | 4134 | 1 | 6 |
| SEQ ID NO: 5609 | gtgcggggcccccccgtgt | 2032 | 2051 | SEQ ID NO: 6155 | acaccacgggcccctgcac | 6537 | 6556 | 1 | 6 |
| SEQ ID NO: 5610 | atgtgggggggcgtggagca | 2238 | 2257 | SEQ ID NO: 6156 | tgctcaatgtcctacacat | 7610 | 7629 | 1 | 6 |
| SEQ ID NO: 5611 | ggagagcgttgcaacttgg | 2288 | 2307 | SEQ ID NO: 6157 | ccaagctcaaactcactcc | 9207 | 9226 | 1 | 6 |
| SEQ ID NO: 5612 | cgtccgttgccggagcgca | 2613 | 2632 | SEQ ID NO: 6158 | tgcgagcccgaaccggacg | 6827 | 6846 | 1 | 6 |
| SEQ ID NO: 5613 | gtctggcattattgaccct | 2817 | 2836 | SEQ ID NO: 6159 | aaggtcacctttgacagac | 7763 | 7782 | 1 | 6 |
| SEQ ID NO: 5614 | tctttgatatcaccaaact | 2997 | 3016 | SEQ ID NO: 6160 | agttcgatgaaatggaaga | 5454 | 5473 | 1 | 6 |
| SEQ ID NO: 5615 | cttctgattgccatactcg | 3014 | 3033 | SEQ ID NO: 6161 | cgagcaattcaagcagaag | 5518 | 5537 | 1 | 6 |
| SEQ ID NO: 5616 | gcggcgtgtggggacatca | 3314 | 3333 | SEQ ID NO: 6162 | tgatcacgccatgcgccgc | 7641 | 7660 | 1 | 6 |
| SEQ ID NO: 5617 | gggacatcatcctgggcct | 3324 | 3343 | SEQ ID NO: 6163 | aggcggtggattttgtccc | 3915 | 3934 | 1 | 6 |
| SEQ ID NO: 5618 | gggcgtcttccgggccgct | 3874 | 3893 | SEQ ID NO: 6164 | agcggcacggcgaccgccc | 7439 | 7458 | 1 | 6 |
| SEQ ID NO: 5619 | ggcgtcttccgggccgctg | 3875 | 3894 | SEQ ID NO: 6165 | cagcggcacggcgaccgcc | 7438 | 7457 | 1 | 6 |
| SEQ ID NO: 5620 | gcgtcttccgggccgctgt | 3876 | 3895 | SEQ ID NO: 6166 | acaggtgccctgatcacgc | 7631 | 7650 | 1 | 6 |
| SEQ ID NO: 5621 | gtccccggtcttcacagac | 3961 | 3980 | SEQ ID NO: 6167 | gtcttggaagaacccggac | 7252 | 7271 | 1 | 6 |
| SEQ ID NO: 5622 | catcaggactggggtaagg | 4174 | 4193 | SEQ ID NO: 6168 | ccttcctcaagccgtgatg | 8155 | 8174 | 1 | 6 |
| SEQ ID NO: 5623 | ccgacggtggttgctccgg | 4245 | 4264 | SEQ ID NO: 6169 | ccggggaacggccctcgg | 4853 | 4872 | 1 | 6 |
| SEQ ID NO: 5624 | gggggggaaggcacctcatt | 4501 | 4520 | SEQ ID NO: 6170 | aatgttgtgacttggcccc | 8334 | 8353 | 1 | 6 |
| SEQ ID NO: 5625 | ccgagcaattcaagcagaa | 5517 | 5536 | SEQ ID NO: 6171 | ttctgattgccatactcgg | 3015 | 3034 | 1 | 6 |
| SEQ ID NO: 5626 | agatgaaggcaaaggcgtc | 7821 | 7840 | SEQ ID NO: 6172 | gacgaccttgtcgttatct | 8564 | 8583 | 1 | 6 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5627 | ccctaggggcgctgcca | 767 | 786 | SEQ ID NO: 6173 | tggccggcgcccccgggg | 3674 | 3693 | 3 | 5 |
| SEQ ID NO: 5628 | ctcccggcctagttgggc | 646 | 665 | SEQ ID NO: 6174 | gccccccttgagggggag | 7519 | 7538 | 2 | 5 |
| SEQ ID NO: 5629 | ttccgctcgtcggcggccc | 750 | 769 | SEQ ID NO: 6175 | gggcaaaggacgtccggaa | 7923 | 7942 | 2 | 5 |
| SEQ ID NO: 5630 | ccctaggggcgctgcca | 767 | 786 | SEQ ID NO: 6176 | tggcggggcccactgggg | 1383 | 1402 | 2 | 5 |
| SEQ ID NO: 5631 | gccccgccggcatgcgaca | 1222 | 1241 | SEQ ID NO: 6177 | tgtcccaggggggaggc | 9147 | 9166 | 2 | 5 |
| SEQ ID NO: 5632 | aggacgaccgggtcctttc | 178 | 197 | SEQ ID NO: 6178 | gaaaaaggacggttgtcct | 7341 | 7360 | 1 | 5 |
| SEQ ID NO: 5633 | ggacgaccgggtcctttct | 179 | 198 | SEQ ID NO: 6179 | agaaaaggacggttgtcc | 7340 | 7359 | 1 | 5 |
| SEQ ID NO: 5634 | aaaaccaaacgtaacacca | 368 | 387 | SEQ ID NO: 6180 | tggttttttttttttttt | 9443 | 9462 | 1 | 5 |
| SEQ ID NO: 5635 | caaccgccgcccacaggac | 385 | 404 | SEQ ID NO: 6181 | gtcctgaacccgtctgttg | 4100 | 4119 | 1 | 5 |
| SEQ ID NO: 5636 | cggtggtcagatcgttggt | 418 | 437 | SEQ ID NO: 6182 | accattgagacgacgaccg | 4754 | 4773 | 1 | 5 |
| SEQ ID NO: 5637 | acctgttgccgcgcagggg | 444 | 463 | SEQ ID NO: 6183 | ccccggccacgcgtcaggt | 1267 | 1286 | 1 | 5 |
| SEQ ID NO: 5638 | tgccgcgcaggggcccag | 450 | 469 | SEQ ID NO: 6184 | ctgggcgcgctgacgggca | 3164 | 3183 | 1 | 5 |
| SEQ ID NO: 5639 | gggccccaggttgggtgtg | 460 | 479 | SEQ ID NO: 6185 | cacagcctgtctcgtgccc | 9296 | 9315 | 1 | 5 |
| SEQ ID NO: 5640 | gttggggcccacggaccc | 657 | 676 | SEQ ID NO: 6186 | gggtgggtagccgcccaac | 5783 | 5802 | 1 | 5 |
| SEQ ID NO: 5641 | ttggggcccacggacccc | 658 | 677 | SEQ ID NO: 6187 | ggggtgggtagccgcccaa | 5782 | 5801 | 1 | 5 |
| SEQ ID NO: 5642 | tggggcccacggaccccc | 659 | 678 | SEQ ID NO: 6188 | gggggtgggtagccgccca | 5781 | 5800 | 1 | 5 |
| SEQ ID NO: 5643 | cctcacatgcggcctcgcc | 715 | 734 | SEQ ID NO: 6189 | ggcggggcgacaatagagg | 3774 | 3793 | 1 | 5 |
| SEQ ID NO: 5644 | cacatgcggcctcgccgac | 718 | 737 | SEQ ID NO: 6190 | gtcgtcggagtcgtgtgtg | 6020 | 6039 | 1 | 5 |
| SEQ ID NO: 5645 | tccgctcgtcggcggcccc | 751 | 770 | SEQ ID NO: 6191 | ggggcaaaggacgtccgga | 7922 | 7941 | 1 | 5 |
| SEQ ID NO: 5646 | ggcgctgccagggccttgg | 776 | 795 | SEQ ID NO: 6192 | ccaagccacagtgtgcgcc | 5110 | 5129 | 1 | 5 |
| SEQ ID NO: 5647 | ccatgtcacgaacgactgc | 943 | 962 | SEQ ID NO: 6193 | gcagcaacacgtggcatgg | 6498 | 6517 | 1 | 5 |
| SEQ ID NO: 5648 | gtgccctgcgttcgggagg | 1019 | 1038 | SEQ ID NO: 6194 | cctcacaacggggggcac | 1495 | 1514 | 1 | 5 |
| SEQ ID NO: 5649 | tgccctgcgttcgggaggg | 1020 | 1039 | SEQ ID NO: 6195 | ccctcacaacgggggggca | 1494 | 1513 | 1 | 5 |
| SEQ ID NO: 5650 | gccctgcgttcgggagggt | 1021 | 1040 | SEQ ID NO: 6196 | accctcacaacggggggc | 1493 | 1512 | 1 | 5 |
| SEQ ID NO: 5651 | aggaatgctaccatcccca | 1085 | 1104 | SEQ ID NO: 6197 | tgggcatcggcacagtcct | 4323 | 4342 | 1 | 5 |
| SEQ ID NO: 5652 | tccccactacgacaaatacg | 1098 | 1117 | SEQ ID NO: 6198 | cgtattcccagatttggga | 8092 | 8111 | 1 | 5 |
| SEQ ID NO: 5653 | atacgacaccacgtcgatt | 1112 | 1131 | SEQ ID NO: 6199 | aatcaatgctgtagcgtat | 4576 | 4595 | 1 | 5 |
| SEQ ID NO: 5654 | atttgctcgttggggcggc | 1128 | 1147 | SEQ ID NO: 6200 | gccgccacttgcggcaaat | 9164 | 9183 | 1 | 5 |
| SEQ ID NO: 5655 | ccttctcgccccgccggca | 1215 | 1234 | SEQ ID NO: 6201 | tgccaacgtgggtacaagg | 637 | 6393 | 1 | 5 |
| SEQ ID NO: 5656 | accccggccacgcgtcagg | 1266 | 1285 | SEQ ID NO: 6202 | cctgccgcggttaccgggt | 6340 | 6359 | 1 | 5 |
| SEQ ID NO: 5657 | gccctcgtagtgtcgcagt | 1331 | 1350 | SEQ ID NO: 6203 | actgcgtcggcatgtgggc | 6046 | 6065 | 1 | 5 |
| SEQ ID NO: 5658 | gccgtctcagagaatccag | 1558 | 1577 | SEQ ID NO: 6204 | ctggtatcgctggtgcggc | 5838 | 5857 | 1 | 5 |
| SEQ ID NO: 5659 | ctgaactgcaatgactccc | 1619 | 1638 | SEQ ID NO: 6205 | gggacagatcggagctcag | 2313 | 2332 | 1 | 5 |
| SEQ ID NO: 5660 | agactgggtttcttgccgc | 1641 | 1660 | SEQ ID NO: 6206 | gcggcgagcctacgagtct | 8609 | 8628 | 1 | 5 |
| SEQ ID NO: 5661 | tcgtccggatgcccggagc | 1685 | 1704 | SEQ ID NO: 6207 | gctccggggggcgcttacga | 4257 | 4276 | 1 | 5 |
| SEQ ID NO: 5662 | ccaggggatggggtcctatc | 1738 | 1757 | SEQ ID NO: 6208 | gataacttcccctacctgg | 5084 | 5103 | 1 | 5 |
| SEQ ID NO: 5663 | gacaaccgatcgtctcggc | 1894 | 1913 | SEQ ID NO: 6209 | gccgcggttaccgggtgtc | 6343 | 6362 | 1 | 5 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5664 | caagacgtgcggggccccc | 2026 | 2045 | SEQ ID NO: 6210 | ggggtctcccccctccttg | 6919 | 6938 | 1 | 5 |
| SEQ ID NO: 5665 | acgtgcggggcccccccgt | 2030 | 2049 | SEQ ID NO: 6211 | acgggcgcccccattacgt | 4202 | 4221 | 1 | 5 |
| SEQ ID NO: 5666 | ccggaagcaccccgaggcc | 2101 | 2120 | SEQ ID NO: 6212 | ggccgctgtatgcacccgg | 3886 | 3905 | 1 | 5 |
| SEQ ID NO: 5667 | aggccacgtactcaaaatg | 2115 | 2134 | SEQ ID NO: 6213 | cattatgtccaaatggcct | 3137 | 3156 | 1 | 5 |
| SEQ ID NO: 5668 | tgtatgtggggggcgtgga | 2235 | 2254 | SEQ ID NO: 6214 | tccaagtggcccatctaca | 4011 | 4030 | 1 | 5 |
| SEQ ID NO: 5669 | gagtggcaggttctgccct | 2354 | 2373 | SEQ ID NO: 6215 | agggcaggggtggcgactc | 3400 | 3419 | 1 | 5 |
| SEQ ID NO: 5670 | tcctttgcaatcaaatggg | 2474 | 2493 | SEQ ID NO: 6216 | cccaccttatgggcaagga | 8861 | 8880 | 1 | 5 |
| SEQ ID NO: 5671 | agcccaggccgaggccgcc | 2566 | 2585 | SEQ ID NO: 6217 | ggcgtccacagtcaaggct | 7834 | 7853 | 1 | 5 |
| SEQ ID NO: 5672 | ggcggcatatgctttctat | 2698 | 2717 | SEQ ID NO: 6218 | atagaagaagcctgccgcc | 7865 | 7884 | 1 | 5 |
| SEQ ID NO: 5673 | gcggcatatgctttctatg | 2699 | 2718 | SEQ ID NO: 6219 | catagaagaagcctgccgc | 7864 | 7883 | 1 | 5 |
| SEQ ID NO: 5674 | cggcatatgctttctatgg | 2700 | 2719 | SEQ ID NO: 6220 | ccatagaagaagcctgccg | 7863 | 7882 | 1 | 5 |
| SEQ ID NO: 5675 | tgcatgtgtgggttccccc | 2913 | 2932 | SEQ ID NO: 6221 | gggggacggcatcatgca | 6402 | 6421 | 1 | 5 |
| SEQ ID NO: 5676 | ccccccctcaacgtccgggg | 2928 | 2947 | SEQ ID NO: 6222 | ccccaatcgatgaacgggg | 9376 | 9395 | 1 | 5 |
| SEQ ID NO: 5677 | gggcaggggtggcgactcc | 3401 | 3420 | SEQ ID NO: 6223 | ggaggccgcaagccagccc | 8066 | 8085 | 1 | 5 |
| SEQ ID NO: 5678 | atgttggactgtctaccat | 3574 | 3593 | SEQ ID NO: 6224 | atggtaccgaccctaacat | 4158 | 4177 | 1 | 5 |
| SEQ ID NO: 5679 | tgttggactgtctaccatg | 3575 | 3594 | SEQ ID NO: 6225 | catggtaccgaccctaaca | 4157 | 4176 | 1 | 5 |
| SEQ ID NO: 5680 | cgttccctgacaccatgca | 3695 | 3714 | SEQ ID NO: 6226 | tgcacgatgctcgtgaacg | 8543 | 8562 | 1 | 5 |
| SEQ ID NO: 5681 | acaccatgcacctgtggca | 3704 | 3723 | SEQ ID NO: 6227 | tgccgcggttaccgggtgt | 6342 | 6361 | 1 | 5 |
| SEQ ID NO: 5682 | caccatgcacctgtggcag | 3705 | 3724 | SEQ ID NO: 6228 | ctgccgcggttaccgggtg | 6341 | 6360 | 1 | 5 |
| SEQ ID NO: 5683 | ggcatcggcacagtcctgg | 4325 | 4344 | SEQ ID NO: 6229 | ccaggattgcccgtttgcc | 4979 | 4998 | 1 | 5 |
| SEQ ID NO: 5684 | aagcggagacggctggagc | 4347 | 4366 | SEQ ID NO: 6230 | gctcccccagcgctgctt | 5804 | 5823 | 1 | 5 |
| SEQ ID NO: 5685 | ggagcgcggcttgtcgtgc | 4361 | 4380 | SEQ ID NO: 6231 | gcacggcgaccgcccctcc | 7443 | 7462 | 1 | 5 |
| SEQ ID NO: 5686 | cgaagccatcaaggggga | 4489 | 4508 | SEQ ID NO: 6232 | tcccccagcgctgcttcg | 5806 | 5825 | 1 | 5 |
| SEQ ID NO: 5687 | tggaagtgtctcatacggc | 5165 | 5184 | SEQ ID NO: 6233 | gccggattacaatcctcca | 7225 | 7244 | 1 | 5 |
| SEQ ID NO: 5688 | gggtgctggtaggcggagt | 5322 | 5341 | SEQ ID NO: 6234 | actcgcgatcccaccaccc | 8765 | 8784 | 1 | 5 |
| SEQ ID NO: 5689 | gtgggtaggatcatcttgt | 5390 | 5409 | SEQ ID NO: 6235 | acaacatggtctacgccac | 7713 | 7732 | 1 | 5 |
| SEQ ID NO: 5690 | cgccgagcaattcaagcag | 5515 | 5534 | SEQ ID NO: 6236 | ctgcacgccttccccggcg | 6550 | 6569 | 1 | 5 |
| SEQ ID NO: 5691 | tggagtccaagtggcgagc | 5592 | 5611 | SEQ ID NO: 6237 | gctcctcatacggattcca | 8175 | 8194 | 1 | 5 |
| SEQ ID NO: 5692 | tggcgagctttggagacct | 5603 | 5622 | SEQ ID NO: 6238 | aggtgccctgatcacgcca | 7633 | 7652 | 1 | 5 |
| SEQ ID NO: 5693 | gcccgctcaccacccagaa | 5739 | 5758 | SEQ ID NO: 6239 | ttctggcgggctatgggc | 5895 | 5914 | 1 | 5 |
| SEQ ID NO: 5694 | tgagtgacttcaagacctg | 6306 | 6325 | SEQ ID NO: 6240 | caggctataaaatcgctca | 8363 | 8382 | 1 | 5 |
| SEQ ID NO: 5695 | atgtcaaaaacggttccat | 6456 | 6475 | SEQ ID NO: 6241 | atggtaccgaccctaacat | 4158 | 4177 | 1 | 5 |
| SEQ ID NO: 5696 | ccgaaaacctgcagcaaca | 6488 | 6507 | SEQ ID NO: 6242 | tgttcctccaatgtgtcgg | 8708 | 8727 | 1 | 5 |
| SEQ ID NO: 5697 | ggcgccaaactattccaag | 6565 | 6584 | SEQ ID NO: 6243 | cttgaaagcctctgccgcc | 8500 | 8519 | 1 | 5 |
| SEQ ID NO: 5698 | gccctccttgagggcgaca | 6967 | 6986 | SEQ ID NO: 6244 | tgtctcctacttgaagggc | 3814 | 3833 | 1 | 5 |
| SEQ ID NO: 5699 | cacccgcgtggagtcggag | 7078 | 7097 | SEQ ID NO: 6245 | ctccggtggtacacgggtg | 7278 | 7297 | 1 | 5 |
| SEQ ID NO: 5700 | ggaggggatgagaatgaa | 7138 | 7157 | SEQ ID NO: 6246 | ttcatgctgtgcctactcc | 9326 | 9345 | 1 | 5 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5701 | gcggcgatacccatatggg | 7202 | 7221 | SEQ ID NO: 6247 | cccagggggggagggccgc | 9150 | 9169 | 1 | 5 |
| SEQ ID NO: 5702 | ttgccacctgtcaaggccc | 7301 | 7320 | SEQ ID NO: 6248 | gggccgccacttgcggcaa | 9162 | 9181 | 1 | 5 |
| SEQ ID NO: 5703 | cccccccttgaggggagc | 7520 | 7539 | SEQ ID NO: 6249 | gctcccggcctagttgggg | 645 | 664 | 1 | 5 |
| SEQ ID NO: 5704 | ctgctgctcaatgtcctac | 7606 | 7625 | SEQ ID NO: 6250 | gtaggactggcagggcag | 4809 | 4828 | 1 | 5 |
| SEQ ID NO: 5705 | catggacaggtgccctgat | 7626 | 7645 | SEQ ID NO: 6251 | atcattgaacgactccatg | 8996 | 9015 | 1 | 5 |
| SEQ ID NO: 5706 | atggacaggtgccctgatc | 7627 | 7646 | SEQ ID NO: 6252 | gatcattgaacgactccat | 8995 | 9014 | 1 | 5 |
| SEQ ID NO: 5707 | ggctatgactaggtactcc | 8635 | 8654 | SEQ ID NO: 6253 | ggagcaacttgaaaaagcc | 8920 | 8939 | 1 | 5 |
| SEQ ID NO: 5708 | caccatagatcactcccct | 27 | 46 | SEQ ID NO: 6254 | agggccttggcacatggtg | 785 | 804 | 2 | 4 |
| SEQ ID NO: 5709 | agctgttcaccttctcgcc | 1206 | 1225 | SEQ ID NO: 6255 | ggcgtgctgacgactagct | 8459 | 8478 | 2 | 4 |
| SEQ ID NO: 5710 | ctgcaatgactccctccag | 1624 | 1643 | SEQ ID NO: 6256 | ctggtgcggctgttggcag | 5847 | 5866 | 2 | 4 |
| SEQ ID NO: 5711 | atgtgggggggcgtggagca | 2238 | 2257 | SEQ ID NO: 6257 | tgctgcgccatcacaacat | 7701 | 7720 | 2 | 4 |
| SEQ ID NO: 5712 | tggggacatcatcctgggc | 3322 | 3341 | SEQ ID NO: 6258 | gcccaactcgctcccccca | 5795 | 5814 | 2 | 4 |
| SEQ ID NO: 5713 | gggacatcatcctgggcct | 3324 | 3343 | SEQ ID NO: 6259 | aggcaggagataacttccc | 5076 | 5095 | 2 | 4 |
| SEQ ID NO: 5714 | gggagatactcctggggcc | 3366 | 3385 | SEQ ID NO: 6260 | ggccctgcacgccttccc | 6545 | 6564 | 2 | 4 |
| SEQ ID NO: 5715 | atgttggactgtctaccat | 3574 | 3593 | SEQ ID NO: 6261 | atggtctacgccacgacat | 7718 | 7737 | 2 | 4 |
| SEQ ID NO: 5716 | ccagccttaccatcaccca | 6189 | 6208 | SEQ ID NO: 6262 | tgggtacaagggagtctgg | 6382 | 6401 | 2 | 4 |
| SEQ ID NO: 5717 | gccctccttgagggcgaca | 6967 | 6986 | SEQ ID NO: 6263 | tgtcccaggggggagggc | 9147 | 9166 | 2 | 4 |
| SEQ ID NO: 5718 | ccagccccgattgggggc | 1 | 20 | SEQ ID NO: 6264 | gcccgagggcagggcctgg | 550 | 569 | 1 | 4 |
| SEQ ID NO: 5719 | accatagatcactcccctg | 28 | 47 | SEQ ID NO: 6265 | cagggccttggcacatggt | 784 | 803 | 1 | 4 |
| SEQ ID NO: 5720 | atgagtgtcgtgcagcctc | 95 | 114 | SEQ ID NO: 6266 | gaggccgcgatgccatcat | 2946 | 2965 | 1 | 4 |
| SEQ ID NO: 5721 | gtgcagcctccaggacccc | 104 | 123 | SEQ ID NO: 6267 | gggggacggcatcatgcac | 6403 | 6422 | 1 | 4 |
| SEQ ID NO: 5722 | tgcagcctccaggacccc | 105 | 124 | SEQ ID NO: 6268 | ggggggacggcatcatgca | 6402 | 6421 | 1 | 4 |
| SEQ ID NO: 5723 | ccaggaccccccctcccgg | 113 | 132 | SEQ ID NO: 6269 | ccggctggttcgttgctgg | 9255 | 9274 | 1 | 4 |
| SEQ ID NO: 5724 | accccccctcccgggagag | 118 | 137 | SEQ ID NO: 6270 | ctctcatgccaacgtgggt | 6368 | 6387 | 1 | 4 |
| SEQ ID NO: 5725 | cccctcccgggagagcca | 121 | 140 | SEQ ID NO: 6271 | tggcaatgagggcatgggg | 598 | 617 | 1 | 4 |
| SEQ ID NO: 5726 | agactgctagccgagtagt | 243 | 262 | SEQ ID NO: 6272 | actatgcggtccccggtct | 3953 | 3972 | 1 | 4 |
| SEQ ID NO: 5727 | agccgagtagtgttgggtc | 251 | 270 | SEQ ID NO: 6273 | gaccaggatctcgtcggct | 3656 | 3675 | 1 | 4 |
| SEQ ID NO: 5728 | ggtgcttgcgagtgcccg | 299 | 318 | SEQ ID NO: 6274 | cggggccttggttgacacc | 2139 | 2158 | 1 | 4 |
| SEQ ID NO: 5729 | gcgagtgccccgggaggtc | 306 | 325 | SEQ ID NO: 6275 | gaccccggcgtaggtcgc | 671 | 690 | 1 | 4 |
| SEQ ID NO: 5730 | accgtgcaccatgagcacg | 331 | 350 | SEQ ID NO: 6276 | cgtgcaatacctgtacggt | 2437 | 2456 | 1 | 4 |
| SEQ ID NO: 5731 | cccgggcggtggtcagatc | 412 | 431 | SEQ ID NO: 6277 | gatcatgcatactcccggg | 997 | 1016 | 1 | 4 |
| SEQ ID NO: 5732 | gccgcgcaggggcccagg | 451 | 470 | SEQ ID NO: 6278 | cctgcacgccttccccggc | 6549 | 6568 | 1 | 4 |
| SEQ ID NO: 5733 | accccgtggaaggcgacag | 511 | 530 | SEQ ID NO: 6279 | ctgtatgcacccgggggg | 3891 | 3910 | 1 | 4 |
| SEQ ID NO: 5734 | ccccgtggaaggcgacagc | 512 | 531 | SEQ ID NO: 6280 | gctgtatgcacccggggg | 3890 | 3909 | 1 | 4 |
| SEQ ID NO: 5735 | agcctatccccaaggctcg | 528 | 547 | SEQ ID NO: 6281 | cgagggcagggcctgggct | 553 | 572 | 1 | 4 |
| SEQ ID NO: 5736 | ctatccccaaggctcgccg | 531 | 550 | SEQ ID NO: 6282 | cggctgtcgttcccgatag | 5418 | 5437 | 1 | 4 |
| SEQ ID NO: 5737 | tatccccaaggctcgccgg | 532 | 551 | SEQ ID NO: 6283 | ccggctgtcgttcccgata | 5417 | 5436 | 1 | 4 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5738 | cgggtatccttggccctc | 577 | 596 | SEQ ID NO: 6284 | gaggccgcaagccagcccg | 8067 | 8086 | 1 | 4 |
| SEQ ID NO: 5739 | gcatggggtgggcaggatg | 609 | 628 | SEQ ID NO: 6285 | catcgatacccttcacatgc | 706 | 725 | 1 | 4 |
| SEQ ID NO: 5740 | tcctgtcaccccgcggctc | 630 | 649 | SEQ ID NO: 6286 | gagctgcaaagctccagga | 8523 | 8542 | 1 | 4 |
| SEQ ID NO: 5741 | gggcccacggaccccgg | 661 | 680 | SEQ ID NO: 6287 | ccggccgcatatgcggccc | 4064 | 4083 | 1 | 4 |
| SEQ ID NO: 5742 | ggccccacggaccccggc | 662 | 681 | SEQ ID NO: 6288 | gccggccgcatatgcggcc | 4063 | 4082 | 1 | 4 |
| SEQ ID NO: 5743 | cggcctcgccgacctcatg | 724 | 743 | SEQ ID NO: 6289 | catgaggatcatcgggccg | 6472 | 6491 | 1 | 4 |
| SEQ ID NO: 5744 | ggcctcgccgacctcatgg | 725 | 744 | SEQ ID NO: 6290 | ccatgaggatcatcgggcc | 6471 | 6490 | 1 | 4 |
| SEQ ID NO: 5745 | ggcccctaggggcgctg | 764 | 783 | SEQ ID NO: 6291 | cagctccgaattgtcggcc | 7414 | 7433 | 1 | 4 |
| SEQ ID NO: 5746 | tggcacatggtgtccgggt | 792 | 811 | SEQ ID NO: 6292 | acccacgctgcacgggcca | 5188 | 5207 | 1 | 4 |
| SEQ ID NO: 5747 | cttcctcttggctctgctg | 868 | 887 | SEQ ID NO: 6293 | cagcataggtcttgggaag | 5863 | 5882 | 1 | 4 |
| SEQ ID NO: 5748 | catgtcacgaacgactgct | 944 | 963 | SEQ ID NO: 6294 | agcagtgctcacttccatg | 6847 | 6866 | 1 | 4 |
| SEQ ID NO: 5749 | gaggcggcggacttgatca | 983 | 1002 | SEQ ID NO: 6295 | tgatggcattcacagcctc | 5712 | 5731 | 1 | 4 |
| SEQ ID NO: 5750 | catccccactacgacaata | 1096 | 1115 | SEQ ID NO: 6296 | tattaccggggtcttgatg | 4592 | 4611 | 1 | 4 |
| SEQ ID NO: 5751 | gctgttcaccttctcgccc | 1207 | 1226 | SEQ ID NO: 6297 | gggctgcgtgggaaacagc | 8793 | 8812 | 1 | 4 |
| SEQ ID NO: 5752 | gccccgccggcatgcgaca | 1222 | 1241 | SEQ ID NO: 6298 | tgtctcctacttgaagggc | 3814 | 3833 | 1 | 4 |
| SEQ ID NO: 5753 | tggcctgggacatgatgat | 1293 | 1312 | SEQ ID NO: 6299 | atcaatttgctccctgcca | 5981 | 6000 | 1 | 4 |
| SEQ ID NO: 5754 | cacaagccgtcatcgacat | 1362 | 1381 | SEQ ID NO: 6300 | atgtttgggactgggtgtg | 6279 | 6298 | 1 | 4 |
| SEQ ID NO: 5755 | agccgtcatcgacatggtg | 1366 | 1385 | SEQ ID NO: 6301 | caccaagcaggcggaggct | 5560 | 5579 | 1 | 4 |
| SEQ ID NO: 5756 | ggtggcggggcccactgg | 1381 | 1400 | SEQ ID NO: 6302 | ccagggctcaggcccccacc | 5127 | 5146 | 1 | 4 |
| SEQ ID NO: 5757 | gggggcccactggggagtc | 1387 | 1406 | SEQ ID NO: 6303 | gactaggtactccgccccc | 8641 | 8660 | 1 | 4 |
| SEQ ID NO: 5758 | atggcggggaactgggcta | 1430 | 1449 | SEQ ID NO: 6304 | tagcagtgctcacttccat | 6846 | 6865 | 1 | 4 |
| SEQ ID NO: 5759 | ttgattgtgatgctactttt | 1454 | 1473 | SEQ ID NO: 6305 | aaagcaagctgcccatcaa | 7665 | 7684 | 1 | 4 |
| SEQ ID NO: 5760 | caacggggggcacgctgc | 1500 | 1519 | SEQ ID NO: 6306 | gcagaaggcgctcgggttg | 5530 | 5549 | 1 | 4 |
| SEQ ID NO: 5761 | acgctgcccgcctcaccag | 1512 | 1531 | SEQ ID NO: 6307 | ctggaccgaggagagcgt | 2278 | 2297 | 1 | 4 |
| SEQ ID NO: 5762 | tcagagaatccagcttata | 1564 | 1583 | SEQ ID NO: 6308 | tatatcggggtcccctga | 8393 | 8412 | 1 | 4 |
| SEQ ID NO: 5763 | accaatggcagttggcaca | 1586 | 1605 | SEQ ID NO: 6309 | tgtggctcggggccttgt | 2132 | 2151 | 1 | 4 |
| SEQ ID NO: 5764 | ccaatggcagttggcacat | 1587 | 1606 | SEQ ID NO: 6310 | atgtggctcggggccttgg | 2131 | 2150 | 1 | 4 |
| SEQ ID NO: 5765 | gtcctatcacttatgctga | 1749 | 1768 | SEQ ID NO: 6311 | tcaggactggggtaaggac | 4176 | 4195 | 1 | 4 |
| SEQ ID NO: 5766 | ctgagcctacaaaagaccc | 1764 | 1783 | SEQ ID NO: 6312 | gggtggcttcatgcctcag | 9063 | 9082 | 1 | 4 |
| SEQ ID NO: 5767 | caggtgtgtggtccagtgt | 1844 | 1863 | SEQ ID NO: 6313 | acactccagttaactcctg | 8817 | 8836 | 1 | 4 |
| SEQ ID NO: 5768 | tgtggtccagtgtattgct | 1850 | 1869 | SEQ ID NO: 6314 | agcagggccatcaaccaca | 7949 | 7968 | 1 | 4 |
| SEQ ID NO: 5769 | gcttcaccccaagtcctgt | 1866 | 1885 | SEQ ID NO: 6315 | acagcagaggcggctaagc | 6887 | 6906 | 1 | 4 |
| SEQ ID NO: 5770 | ctgttgtcgtggggacaac | 1881 | 1900 | SEQ ID NO: 6316 | gttgcaacttggacgacag | 2295 | 2314 | 1 | 4 |
| SEQ ID NO: 5771 | gccgccgcaaggcaactgg | 1972 | 1991 | SEQ ID NO: 6317 | ccagttggacttatccggc | 9241 | 9260 | 1 | 4 |
| SEQ ID NO: 5772 | ggcaactggttcggctgta | 1982 | 2001 | SEQ ID NO: 6318 | tacacgggtgccattgcc | 7287 | 7306 | 1 | 4 |
| SEQ ID NO: 5773 | gcaactggttcggctgtac | 1983 | 2002 | SEQ ID NO: 6319 | gtacacgggtgccattgc | 7286 | 7305 | 1 | 4 |
| SEQ ID NO: 5774 | ccccgtgtaacatcggggg | 2043 | 2062 | SEQ ID NO: 6320 | ccccaatcgatgaacgggg | 9376 | 9395 | 1 | 4 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5775 | ggactgcttccggaagcac | 2092 | 2111 | SEQ ID NO: 6321 | gtgctggtaggcggagtcc | 5324 | 5343 | 1 | 4 |
| SEQ ID NO: 5776 | gactgcttccggaagcacc | 2093 | 2112 | SEQ ID NO: 6322 | ggtgctggtaggcggagtc | 5323 | 5342 | 1 | 4 |
| SEQ ID NO: 5777 | tccggaagcaccccgaggc | 2100 | 2119 | SEQ ID NO: 6323 | gcctacgagtcttcacgga | 8616 | 8635 | 1 | 4 |
| SEQ ID NO: 5778 | actcaaaatgtggctcggg | 2124 | 2143 | SEQ ID NO: 6324 | cccgggcagcgggtcgagt | 8201 | 8220 | 1 | 4 |
| SEQ ID NO: 5779 | ggccttggttgacacctag | 2142 | 2161 | SEQ ID NO: 6325 | ctagccggcccaaaaggcc | 3611 | 3630 | 1 | 4 |
| SEQ ID NO: 5780 | aggagagcgttgcaacttg | 2287 | 2306 | SEQ ID NO: 6326 | caagccgtgatgggctcct | 8162 | 8181 | 1 | 4 |
| SEQ ID NO: 5781 | ggacagatcggagctcagc | 2314 | 2333 | SEQ ID NO: 6327 | gctgggggtcattatgtcc | 3128 | 3147 | 1 | 4 |
| SEQ ID NO: 5782 | cagatcggagctcagcccg | 2317 | 2336 | SEQ ID NO: 6328 | cgggtggcccactgctctg | 3837 | 3856 | 1 | 4 |
| SEQ ID NO: 5783 | ggagctcagcccgctgctg | 2323 | 2342 | SEQ ID NO: 6329 | cagctgctgaagaggctcc | 6206 | 6225 | 1 | 4 |
| SEQ ID NO: 5784 | caccctaccggctctgtcc | 2383 | 2402 | SEQ ID NO: 6330 | ggactgggtgtgcacggtg | 6286 | 6305 | 1 | 4 |
| SEQ ID NO: 5785 | cggctctgtccactggctt | 2391 | 2410 | SEQ ID NO: 6331 | aagcaggcggaggctgccg | 5564 | 5583 | 1 | 4 |
| SEQ ID NO: 5786 | ccatcagaacatcgtggac | 2419 | 2438 | SEQ ID NO: 6332 | gtccccgttgagtccatgg | 3929 | 3948 | 1 | 4 |
| SEQ ID NO: 5787 | ggtcagcggttgtctcctt | 2460 | 2479 | SEQ ID NO: 6333 | aaggatgattctgatgacc | 8875 | 8894 | 1 | 4 |
| SEQ ID NO: 5788 | gccgccttagagaacctgg | 2579 | 2598 | SEQ ID NO: 6334 | ccagttggacttatccggc | 9241 | 9260 | 1 | 4 |
| SEQ ID NO: 5789 | gccttagagaacctggtgg | 2582 | 2601 | SEQ ID NO: 6335 | ccaccaagcaggcggaggc | 5559 | 5578 | 1 | 4 |
| SEQ ID NO: 5790 | gccggagcgcacggcatcc | 2621 | 2640 | SEQ ID NO: 6336 | ggattgggcccacgccggc | 3214 | 3233 | 1 | 4 |
| SEQ ID NO: 5791 | gctgcatcgtgcggaggcg | 2786 | 2805 | SEQ ID NO: 6337 | cgccacgacatcccgcagc | 7726 | 7745 | 1 | 4 |
| SEQ ID NO: 5792 | attattgaccttgtcgcca | 2824 | 2843 | SEQ ID NO: 6338 | tggcaacagacgctctaat | 4647 | 4666 | 1 | 4 |
| SEQ ID NO: 5793 | tcgccatattacaaggtgt | 2837 | 2856 | SEQ ID NO: 6339 | acacaatctttcctggcga | 3539 | 3558 | 1 | 4 |
| SEQ ID NO: 5794 | cgccatattacaaggtgtt | 2838 | 2857 | SEQ ID NO: 6340 | aacacaatctttcctggcg | 3538 | 3557 | 1 | 4 |
| SEQ ID NO: 5795 | gtccggggaggccgcgatg | 2939 | 2958 | SEQ ID NO: 6341 | catcggcacagtcctggac | 4327 | 4346 | 1 | 4 |
| SEQ ID NO: 5796 | tcaccccactgcgggattg | 3201 | 3220 | SEQ ID NO: 6342 | caatttaccaatgttgtga | 8325 | 8344 | 1 | 4 |
| SEQ ID NO: 5797 | ttgggcccacgccggccta | 3217 | 3236 | SEQ ID NO: 6343 | taggctagggccgtccaa | 5221 | 5240 | 1 | 4 |
| SEQ ID NO: 5798 | ctacgggaccttgcggtag | 3233 | 3252 | SEQ ID NO: 6344 | ctactcctactttctgtag | 9338 | 9357 | 1 | 4 |
| SEQ ID NO: 5799 | cctgtcgtcttctctgaca | 3260 | 3279 | SEQ ID NO: 6345 | tgtcctacacatggacagg | 7617 | 7636 | 1 | 4 |
| SEQ ID NO: 5800 | ctgtcgtcttctctgacat | 3261 | 3280 | SEQ ID NO: 6346 | atgtcctacacatggacag | 7616 | 7635 | 1 | 4 |
| SEQ ID NO: 5801 | cctgggggcagacaccgc | 3297 | 3316 | SEQ ID NO: 6347 | gcggggtaggactggcagg | 4804 | 4823 | 1 | 4 |
| SEQ ID NO: 5802 | gggggcagacaccgcggcg | 3301 | 3320 | SEQ ID NO: 6348 | cgcccaactcgctcccccc | 5794 | 5813 | 1 | 4 |
| SEQ ID NO: 5803 | ggcgtgtggggacatcatc | 3316 | 3335 | SEQ ID NO: 6349 | gatgttattccggtgcgcc | 3755 | 3774 | 1 | 4 |
| SEQ ID NO: 5804 | tggggccggccgatagtct | 3378 | 3397 | SEQ ID NO: 6350 | agacgacgaccgtgccca | 4761 | 4780 | 1 | 4 |
| SEQ ID NO: 5805 | gaaccaggtcgaggggag | 3499 | 3518 | SEQ ID NO: 6351 | ctccacctatggcaagttc | 4222 | 4241 | 1 | 4 |
| SEQ ID NO: 5806 | gagggggaggttcaagtgg | 3509 | 3528 | SEQ ID NO: 6352 | ccacctgtcaaggcccctc | 7304 | 7323 | 1 | 4 |
| SEQ ID NO: 5807 | aggcccaatcgcccagatg | 3625 | 3644 | SEQ ID NO: 6353 | catcccgcagcgcgggcct | 7734 | 7753 | 1 | 4 |
| SEQ ID NO: 5808 | ggcccaatcgcccagatgt | 3626 | 3645 | SEQ ID NO: 6354 | acatcccgcagcgcgggcc | 7733 | 7752 | 1 | 4 |
| SEQ ID NO: 5809 | caggatctcgtcggctggc | 3659 | 3678 | SEQ ID NO: 6355 | gccaataggccatttcctg | 9410 | 9429 | 1 | 4 |
| SEQ ID NO: 5810 | aggatctcgtcggctggcc | 3660 | 3679 | SEQ ID NO: 6356 | ggccaataggccatttcct | 9409 | 9428 | 1 | 4 |
| SEQ ID NO: 5811 | gcccccggggcgcgttcc | 3682 | 3701 | SEQ ID NO: 6357 | ggaacctatccagcagggc | 7938 | 7957 | 1 | 4 |

TABLE 13-continued

Selected palindromic sequences from human hepatitis C virus (HCV)

| | Source | Start Index | End Index | | Match | Start Index | End Index | # | B |
|---|---|---|---|---|---|---|---|---|---|
| SEQ ID NO: 5812 | gcacctgtggcagctcgga | 3711 | 3730 | SEQ ID NO: 6358 | tccggtggtacacgggtgc | 7279 | 7298 | 1 | 4 |
| SEQ ID NO: 5813 | ctgtggcagctcggacctt | 3715 | 3734 | SEQ ID NO: 6359 | aaggcaaaggcgtccacag | 7826 | 7845 | 1 | 4 |
| SEQ ID NO: 5814 | gcggggcgacaatagaggg | 3775 | 3794 | SEQ ID NO: 6360 | ccctgcctgggaaccccgc | 5682 | 5701 | 1 | 4 |
| SEQ ID NO: 5815 | ggagcttgctctcccccag | 3792 | 3811 | SEQ ID NO: 6361 | ctggttgggtcacagctcc | 6806 | 6825 | 1 | 4 |
| SEQ ID NO: 5816 | gagcttgctctcccccagg | 3793 | 3812 | SEQ ID NO: 6362 | cctggttgggtcacagctc | 6805 | 6824 | 1 | 4 |
| SEQ ID NO: 5817 | acttgaagggctcttcggg | 3822 | 3841 | SEQ ID NO: 6363 | cccgtggtggagtccaagt | 5585 | 5604 | 1 | 4 |
| SEQ ID NO: 5818 | tgtccccgttgagtccatg | 3928 | 3947 | SEQ ID NO: 6364 | catggtctacgccacgaca | 7717 | 7736 | 1 | 4 |
| SEQ ID NO: 5819 | gaaactactatgcggtccc | 3947 | 3966 | SEQ ID NO: 6365 | gggaaggcacctcattttc | 4504 | 4523 | 1 | 4 |
| SEQ ID NO: 5820 | aaactactatgcggtcccc | 3948 | 3967 | SEQ ID NO: 6366 | gggggcatatacaggttt | 4828 | 4847 | 1 | 4 |
| SEQ ID NO: 5821 | ctcccactggcagcggcaa | 4032 | 4051 | SEQ ID NO: 6367 | ttgccaggaccatctggag | 4993 | 5012 | 1 | 4 |
| SEQ ID NO: 5822 | ggcgtatatgtctaaagca | 4138 | 4157 | SEQ ID NO: 6368 | tgctcgccaccgctacgcc | 4377 | 4396 | 1 | 4 |
| SEQ ID NO: 5823 | gcgtatatgtctaaagcac | 4139 | 4158 | SEQ ID NO: 6369 | gtgctcgccaccgctacgc | 4376 | 4395 | 1 | 4 |
| SEQ ID NO: 5824 | tggggtaaggaccattacc | 4183 | 4202 | SEQ ID NO: 6370 | ggtaaccatgtctccccca | 6119 | 6138 | 1 | 4 |
| SEQ ID NO: 5825 | accattccacgggcgccc | 4193 | 4212 | SEQ ID NO: 6371 | gggcgctggtatcgctggt | 5833 | 5852 | 1 | 4 |
| SEQ ID NO: 5826 | cgtactccacctatggcaa | 4218 | 4237 | SEQ ID NO: 6372 | ttgccccaaccagaatacg | 8669 | 8688 | 1 | 4 |
| SEQ ID NO: 5827 | cagtcctggaccaagcgga | 4335 | 4354 | SEQ ID NO: 6373 | tccgtgagccgcatgactg | 9560 | 9579 | 1 | 4 |
| SEQ ID NO: 5828 | aggggggaaggcacctcat | 4500 | 4519 | SEQ ID NO: 6374 | atgagcggcgaggcgccct | 5948 | 5967 | 1 | 4 |
| SEQ ID NO: 5829 | cactccaagaagaagtgcg | 4526 | 4545 | SEQ ID NO: 6375 | cgcatgactgcagagagtg | 9569 | 9588 | 1 | 4 |
| SEQ ID NO: 5830 | atcaatgctgtagcgtatt | 4577 | 4596 | SEQ ID NO: 6376 | aatacgacttggagttgat | 8682 | 8701 | 1 | 4 |
| SEQ ID NO: 5831 | cataccgaccagcggagac | 4618 | 4637 | SEQ ID NO: 6377 | gtctcccccacgcactatg | 6128 | 6147 | 1 | 4 |
| SEQ ID NO: 5832 | aggactggcaggggcaggg | 4811 | 4830 | SEQ ID NO: 6378 | ccctgccatcctctctcct | 5992 | 6011 | 1 | 4 |
| SEQ ID NO: 5833 | gggaacggccctcgggcat | 4857 | 4876 | SEQ ID NO: 6379 | atgctcaccgaccctccc | 6863 | 6882 | 1 | 4 |
| SEQ ID NO: 5834 | cgggcatgttcgattcctc | 4869 | 4888 | SEQ ID NO: 6380 | gaggccgcaagccagccg | 8067 | 8086 | 1 | 4 |
| SEQ ID NO: 5835 | tggtacgagctcacccccg | 4922 | 4941 | SEQ ID NO: 6381 | cggggacttgccccaacca | 8662 | 8681 | 1 | 4 |
| SEQ ID NO: 5836 | gggcttacctaaatacacc | 4962 | 4981 | SEQ ID NO: 6382 | ggtggctccatcttagccc | 9518 | 9537 | 1 | 4 |
| SEQ ID NO: 5837 | ggcttacctaaatacacca | 4963 | 4982 | SEQ ID NO: 6383 | tggtggctccatcttagcc | 9517 | 9536 | 1 | 4 |
| SEQ ID NO: 5838 | gagataacttcccctacct | 5082 | 5101 | SEQ ID NO: 6384 | aggttggccaggggtctc | 6908 | 6927 | 1 | 4 |
| SEQ ID NO: 5839 | cccacctccatcgtgggat | 5140 | 5159 | SEQ ID NO: 6385 | atccaagtttggctatggg | 7906 | 7925 | 1 | 4 |
| SEQ ID NO: 5840 | catggcatgcatgtcggcc | 5278 | 5297 | SEQ ID NO: 6386 | ggcctctctgcagatcatg | 9596 | 9615 | 1 | 4 |
| SEQ ID NO: 5841 | ggccgacctggaagtcgtc | 5293 | 5312 | SEQ ID NO: 6387 | gacgccccacattcggcc | 7885 | 7904 | 1 | 4 |
| SEQ ID NO: 5842 | gccgacctggaagtcgtca | 5294 | 5313 | SEQ ID NO: 6388 | tgacgccccacattcggc | 7884 | 7903 | 1 | 4 |
| SEQ ID NO: 5843 | tggaagtcgtcaccagcac | 5301 | 5320 | SEQ ID NO: 6389 | gtgccatgtcaggttcca | 6676 | 6695 | 1 | 4 |
| SEQ ID NO: 5844 | gcacctgggtgctggtagg | 5316 | 5335 | SEQ ID NO: 6390 | cctacacatggacaggtgc | 7620 | 7639 | 1 | 4 |
| SEQ ID NO: 5845 | ggttatcgtgggtaggatc | 5383 | 5402 | SEQ ID NO: 6391 | gatcatcgggccgaaaacc | 6478 | 6497 | 1 | 4 |
| SEQ ID NO: 5846 | cccgatagggaagtcctct | 5429 | 5448 | SEQ ID NO: 6392 | agagcggctttatatcggg | 8383 | 8402 | 1 | 4 |
| SEQ ID NO: 5847 | tgaaatggaagaatgcgcc | 5461 | 5480 | SEQ ID NO: 6393 | ggcgcgctcgtggccttca | 5924 | 5943 | 1 | 4 |
| SEQ ID NO: 5848 | ccaagtggcgagctttgga | 5598 | 5617 | SEQ ID NO: 6394 | tccattgttagagtcttgg | 7240 | 7259 | 1 | 4 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5849 | ttcatcagcgggatacagt | 5645 | 5664 | SEQ ID NO: 6395 | actgcacgatgctcgtgaa | 8541 | 8560 | 1 | 4 |
| SEQ ID NO: 5850 | agcgggcttatccaccctg | 5668 | 5687 | SEQ ID NO: 6396 | caggggtggctggcgcgct | 5913 | 5932 | 1 | 4 |
| SEQ ID NO: 5851 | ccagcccgctcaccaccca | 5736 | 5755 | SEQ ID NO: 6397 | tgggcgctggtatcgctgg | 5832 | 5851 | 1 | 4 |
| SEQ ID NO: 5852 | gtgggcgctggtatcgctg | 5831 | 5850 | SEQ ID NO: 6398 | cagcagggccatcaaccac | 7948 | 7967 | 1 | 4 |
| SEQ ID NO: 5853 | ggaaggtgctagtggacat | 5877 | 5896 | SEQ ID NO: 6399 | atgtggtctccacccttcc | 8142 | 8161 | 1 | 4 |
| SEQ ID NO: 5854 | ggtcatgagcggcgaggcg | 5944 | 5963 | SEQ ID NO: 6400 | cgccctcctgaccagacc | 7453 | 7472 | 1 | 4 |
| SEQ ID NO: 5855 | catgtgggcccgggagagg | 6056 | 6075 | SEQ ID NO: 6401 | cctccttgagggcgacatg | 6969 | 6988 | 1 | 4 |
| SEQ ID NO: 5856 | atgtgggcccgggagaggg | 6057 | 6076 | SEQ ID NO: 6402 | ccctccttgagggcgacat | 6968 | 6987 | 1 | 4 |
| SEQ ID NO: 5857 | ggggccgtgcagtggatga | 6074 | 6093 | SEQ ID NO: 6403 | tcatgctcctctatgcccc | 7505 | 7524 | 1 | 4 |
| SEQ ID NO: 5858 | gcgttcgcttcgcgggta | 6104 | 6123 | SEQ ID NO: 6404 | taccaccacgagcttacgc | 2751 | 2770 | 1 | 4 |
| SEQ ID NO: 5859 | gggtaaccatgtctcccc | 6117 | 6136 | SEQ ID NO: 6405 | ggggagccggggaccc | 7531 | 7550 | 1 | 4 |
| SEQ ID NO: 5860 | catcacccagctgctgaag | 6199 | 6218 | SEQ ID NO: 6406 | cttcgagcggaggggatg | 7130 | 7149 | 1 | 4 |
| SEQ ID NO: 5861 | aggactgttctacgccgtg | 6240 | 6259 | SEQ ID NO: 6407 | cacggcgaccgccctcct | 7444 | 7463 | 1 | 4 |
| SEQ ID NO: 5862 | ttcaagacctggctccagt | 6314 | 6333 | SEQ ID NO: 6408 | actgcacgatgctcgtgaa | 8541 | 8560 | 1 | 4 |
| SEQ ID NO: 5863 | ctcctgccgcggttaccgg | 6338 | 6357 | SEQ ID NO: 6409 | ccgggacgtgcttaaggag | 7804 | 7823 | 1 | 4 |
| SEQ ID NO: 5864 | caccacgggcccctgcacg | 6538 | 6557 | SEQ ID NO: 6410 | cgtggaggtcacgcgggtg | 6613 | 6632 | 1 | 4 |
| SEQ ID NO: 5865 | ggaggtcacgcgggtgggg | 6616 | 6635 | SEQ ID NO: 6411 | cccctccaataccacctcc | 7317 | 7336 | 1 | 4 |
| SEQ ID NO: 5866 | gaggtcacgcgggtggggg | 6617 | 6636 | SEQ ID NO: 6412 | cccctcctgaccagacctc | 7455 | 7474 | 1 | 4 |
| SEQ ID NO: 5867 | atgtcaggttccagctcct | 6682 | 6701 | SEQ ID NO: 6413 | aggagatgggcggaaacat | 7059 | 7078 | 1 | 4 |
| SEQ ID NO: 5868 | atgaaatatccattgcggc | 7152 | 7171 | SEQ ID NO: 6414 | gccgtgatgggctcctcat | 8165 | 8184 | 1 | 4 |
| SEQ ID NO: 5869 | ctccattgttagagtcttg | 7239 | 7258 | SEQ ID NO: 6415 | caagtggcgagctttggag | 5599 | 5618 | 1 | 4 |
| SEQ ID NO: 5870 | tgcccattgccacctgtca | 7295 | 7314 | SEQ ID NO: 6416 | tgactaattcaaaagggca | 8409 | 8428 | 1 | 4 |
| SEQ ID NO: 5871 | accacctccacggagaaaa | 7327 | 7346 | SEQ ID NO: 6417 | ttttttccctctttatggt | 9502 | 9521 | 1 | 4 |
| SEQ ID NO: 5872 | ccacctccacggagaaaaa | 7328 | 7347 | SEQ ID NO: 6418 | ttttccctctttatggtgg | 9504 | 9523 | 1 | 4 |
| SEQ ID NO: 5873 | acctccacggagaaaaagg | 7330 | 7349 | SEQ ID NO: 6419 | cctttgacagactgcaggt | 7770 | 7789 | 1 | 4 |
| SEQ ID NO: 5874 | ggttgtcctgacggactcc | 7351 | 7370 | SEQ ID NO: 6420 | ggagctcgctaccaaaacc | 7390 | 7409 | 1 | 4 |
| SEQ ID NO: 5875 | cctgaccagacctccgaca | 7460 | 7479 | SEQ ID NO: 6421 | tgtcctacacatggacagg | 7617 | 7636 | 1 | 4 |
| SEQ ID NO: 5876 | agcaagctgcccatcaacg | 7667 | 7686 | SEQ ID NO: 6422 | cgttgagcaactctttgct | 7686 | 7705 | 1 | 4 |
| SEQ ID NO: 5877 | ggatgaccattaccgggac | 7792 | 7811 | SEQ ID NO: 6423 | gtcccagttggacttatcc | 9238 | 9257 | 1 | 4 |
| SEQ ID NO: 5878 | tgcaaagaatgaggtttt | 8028 | 8047 | SEQ ID NO: 6424 | aaaaagccctggattgcca | 8931 | 8950 | 1 | 4 |
| SEQ ID NO: 5879 | gcaaagaatgaggttttc | 8029 | 8048 | SEQ ID NO: 6425 | gaaaagccctggattgcc | 8930 | 8949 | 1 | 4 |
| SEQ ID NO: 5880 | gggcagcgggtcgagttcc | 8204 | 8223 | SEQ ID NO: 6426 | ggaagaaagcaagctgccc | 7660 | 7679 | 1 | 4 |
| SEQ ID NO: 5881 | gactagctgcggtaatacc | 8470 | 8489 | SEQ ID NO: 6427 | ggtaccgcccttgcgagtc | 9091 | 9110 | 1 | 4 |
| SEQ ID NO: 5882 | ctcgcgatcccaccacccc | 8766 | 8785 | SEQ ID NO: 6428 | ggggtaccgcccttgcgag | 9089 | 9108 | 1 | 4 |
| SEQ ID NO: 5883 | aggatgattctgatgaccc | 8876 | 8895 | SEQ ID NO: 6429 | gggtcagcggttgtctcct | 2459 | 2478 | 1 | 4 |
| SEQ ID NO: 5884 | agccacttgacctacctca | 8976 | 8995 | SEQ ID NO: 6430 | tgagatcaataggtggct | 9052 | 9071 | 1 | 4 |
| SEQ ID NO: 5885 | gggtaccgcccttgcgagt | 9090 | 9109 | SEQ ID NO: 6431 | actcgcgatcccaccaccc | 8765 | 8784 | 1 | 4 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5886 | ctgcaatgactccctccag | 1624 | 1643 | SEQ ID NO: 6432 | ctggcgggctatggggcag | 5897 | 5916 | 3 | 3 |
| SEQ ID NO: 5887 | ccagcccccgattgggggc | 1 | 20 | SEQ ID NO: 6433 | gcccactggggagtcctgg | 1391 | 1410 | 2 | 3 |
| SEQ ID NO: 5888 | aaggcgacagcctatcccc | 520 | 539 | SEQ ID NO: 6434 | gggggtctccccccctcctt | 6918 | 6937 | 2 | 3 |
| SEQ ID NO: 5889 | ggccccacggaccccggc | 662 | 681 | SEQ ID NO: 6435 | gccgcaaagctgtcaggcc | 4553 | 4572 | 2 | 3 |
| SEQ ID NO: 5890 | gaggcggcggacttgatca | 983 | 1002 | SEQ ID NO: 6436 | tgataacatcatgttcctc | 8697 | 8716 | 2 | 3 |
| SEQ ID NO: 5891 | ctgcaattgttcgatctac | 1249 | 1268 | SEQ ID NO: 6437 | gtaggcggagtcctcgcag | 5330 | 5349 | 2 | 3 |
| SEQ ID NO: 5892 | ctccagactgggtttcttg | 1637 | 1656 | SEQ ID NO: 6438 | caagtggcgagctttggag | 5599 | 5618 | 2 | 3 |
| SEQ ID NO: 5893 | tcgtacctgcgtcgcaggt | 1830 | 1849 | SEQ ID NO: 6439 | acctcagatcattgaacga | 8989 | 9008 | 2 | 3 |
| SEQ ID NO: 5894 | caagacgtgcggggccccc | 2026 | 2045 | SEQ ID NO: 6440 | gggggagggccgccacttg | 9156 | 9175 | 2 | 3 |
| SEQ ID NO: 5895 | aatgctgcatgcaactgga | 2264 | 2283 | SEQ ID NO: 6441 | tccaggccaataggccatt | 9405 | 9424 | 2 | 3 |
| SEQ ID NO: 5896 | caccctaccggctctgtcc | 2383 | 2402 | SEQ ID NO: 6442 | ggactacgtccctccggtg | 7267 | 7286 | 2 | 3 |
| SEQ ID NO: 5897 | cgccatattacaaggtgtt | 2838 | 2857 | SEQ ID NO: 6443 | aacagccaccaagcaggcg | 5554 | 5573 | 2 | 3 |
| SEQ ID NO: 5898 | cgaagccatcaagggggga | 4489 | 4508 | SEQ ID NO: 6444 | tcccagatttgggagttcg | 8097 | 8116 | 2 | 3 |
| SEQ ID NO: 5899 | ccagcccgctcaccaccca | 5736 | 5755 | SEQ ID NO: 6445 | tgggtacaagggagtctgg | 6382 | 6401 | 2 | 3 |
| SEQ ID NO: 5900 | ggctatgactaggtactcc | 8635 | 8654 | SEQ ID NO: 6446 | ggagacatatatcacagcc | 9284 | 9303 | 2 | 3 |
| SEQ ID NO: 5901 | ctccaccatagatcactcc | 24 | 43 | SEQ ID NO: 6447 | ggagacatcgggccaggag | 9111 | 9130 | 1 | 3 |
| SEQ ID NO: 5902 | tccaccatagatcactccc | 25 | 44 | SEQ ID NO: 6448 | gggagttcgatgaaatgga | 5451 | 5470 | 1 | 3 |
| SEQ ID NO: 5903 | caccatagatcactcccct | 27 | 46 | SEQ ID NO: 6449 | aggggccccaggttgggtg | 458 | 477 | 1 | 3 |
| SEQ ID NO: 5904 | tcactcccctgtgaggaac | 36 | 55 | SEQ ID NO: 6450 | gttctggaggacggcgtga | 809 | 828 | 1 | 3 |
| SEQ ID NO: 5905 | cgttagtatgagtgtcgtg | 88 | 107 | SEQ ID NO: 6451 | cacgctgcacgggccaacg | 5191 | 5210 | 1 | 3 |
| SEQ ID NO: 5906 | tgtcgtgcagcctccagga | 100 | 119 | SEQ ID NO: 6452 | tcctgttgtcgtggggaca | 1879 | 1898 | 1 | 3 |
| SEQ ID NO: 5907 | ccccccctcccgggagagc | 119 | 138 | SEQ ID NO: 6453 | gctcccggcctagttgggg | 645 | 664 | 1 | 3 |
| SEQ ID NO: 5908 | ggagagccatagtggtctg | 131 | 150 | SEQ ID NO: 6454 | cagatcattgaacgactcc | 8993 | 9012 | 1 | 3 |
| SEQ ID NO: 5909 | gagccatagtggtctgcgg | 134 | 153 | SEQ ID NO: 6455 | ccgctgctgggtagcgctc | 1048 | 1067 | 1 | 3 |
| SEQ ID NO: 5910 | gtggtctgcggaaccggtg | 142 | 161 | SEQ ID NO: 6456 | cacccatatagatgcccac | 5038 | 5057 | 1 | 3 |
| SEQ ID NO: 5911 | agtacaccggaattgccag | 161 | 180 | SEQ ID NO: 6457 | ctggcgggccttgcctact | 1406 | 1425 | 1 | 3 |
| SEQ ID NO: 5912 | ggtcctttcttggatcaac | 188 | 207 | SEQ ID NO: 6458 | gttgagtgacttcaagacc | 6304 | 6323 | 1 | 3 |
| SEQ ID NO: 5913 | ttcttggatcaacccgctc | 194 | 213 | SEQ ID NO: 6459 | gagcggaggggatgagaa | 7134 | 7153 | 1 | 3 |
| SEQ ID NO: 5914 | ctcaatgcctggagatttg | 210 | 229 | SEQ ID NO: 6460 | caaagactccgacgctgag | 7486 | 7505 | 1 | 3 |
| SEQ ID NO: 5915 | tgcctggagatttgggcgt | 215 | 234 | SEQ ID NO: 6461 | acgcggccgccgcaaggca | 1967 | 1986 | 1 | 3 |
| SEQ ID NO: 5916 | gcctggagatttgggcgtg | 216 | 235 | SEQ ID NO: 6462 | cacgcggccgccgcaaggc | 1966 | 1985 | 1 | 3 |
| SEQ ID NO: 5917 | gagatttgggcgtgccccc | 221 | 240 | SEQ ID NO: 6463 | ggggacaaccgatcgtctc | 1891 | 1910 | 1 | 3 |
| SEQ ID NO: 5918 | aaaggccttgtggtactgc | 273 | 292 | SEQ ID NO: 6464 | gcagaagaaggtcacctt | 7756 | 7775 | 1 | 3 |
| SEQ ID NO: 5919 | aaggccttgtggtactgcc | 274 | 293 | SEQ ID NO: 6465 | ggcagaagaaggtcacctt | 7755 | 7774 | 1 | 3 |
| SEQ ID NO: 5920 | gtggtactgcctgatagg | 282 | 301 | SEQ ID NO: 6466 | ccctaccggctctgtccac | 2385 | 2404 | 1 | 3 |
| SEQ ID NO: 5921 | cctgatagggtgcttgcga | 291 | 310 | SEQ ID NO: 6467 | tcgccggcccgagggcagg | 544 | 563 | 1 | 3 |
| SEQ ID NO: 5922 | cgagtgccccgggaggtct | 307 | 326 | SEQ ID NO: 6468 | agacgcagtgtcgcgctcg | 4780 | 4799 | 1 | 3 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5923 | gccccgggaggtctcgtag | 312 | 331 | SEQ ID NO: 6469 | ctaccttaggttttggggc | 4122 | 4141 | 1 | 3 |
| SEQ ID NO: 5924 | ttacctgttgccgcgcagg | 442 | 461 | SEQ ID NO: 6470 | cctgcgttcgggagggtaa | 1023 | 1042 | 1 | 3 |
| SEQ ID NO: 5925 | tacctgttgccgcgcaggg | 443 | 462 | SEQ ID NO: 6471 | ccctgcgttcgggagggta | 1022 | 1041 | 1 | 3 |
| SEQ ID NO: 5926 | cctgttgccgcgcaggggc | 445 | 464 | SEQ ID NO: 6472 | gcccccgaagccagacagg | 8348 | 8367 | 1 | 3 |
| SEQ ID NO: 5927 | ctgttgccgcgcaggggcc | 446 | 465 | SEQ ID NO: 6473 | ggcccccgaagccagacag | 8347 | 8366 | 1 | 3 |
| SEQ ID NO: 5928 | tccgagcggtcgcaacccc | 497 | 516 | SEQ ID NO: 6474 | ggggcaaaggacgtccgga | 7922 | 7941 | 1 | 3 |
| SEQ ID NO: 5929 | ggtcgcaaccccgtggaag | 504 | 523 | SEQ ID NO: 6475 | cttctctgacatggagacc | 3268 | 3287 | 1 | 3 |
| SEQ ID NO: 5930 | gtcgcaaccccgtggaagg | 505 | 524 | SEQ ID NO: 6476 | ccttcaccattgagacgac | 4749 | 4768 | 1 | 3 |
| SEQ ID NO: 5931 | aaggcgacagcctatcccc | 520 | 539 | SEQ ID NO: 6477 | ggggcgctgccagggcctt | 774 | 793 | 1 | 3 |
| SEQ ID NO: 5932 | cagcctatccccaaggctc | 527 | 546 | SEQ ID NO: 6478 | gagcacaggcttaatgctg | 2252 | 2271 | 1 | 3 |
| SEQ ID NO: 5933 | gagggcagggcctgggctc | 554 | 573 | SEQ ID NO: 6479 | gagcgtcttcacaggcctc | 5020 | 5039 | 1 | 3 |
| SEQ ID NO: 5934 | cagggcctgggctcagccc | 559 | 578 | SEQ ID NO: 6480 | gggcatcggcacagtcctg | 4324 | 4343 | 1 | 3 |
| SEQ ID NO: 5935 | gggcctgggctcagcccgg | 561 | 580 | SEQ ID NO: 6481 | ccggccgcatatgcggccc | 4064 | 4083 | 1 | 3 |
| SEQ ID NO: 5936 | cctgggctcagcccgggta | 564 | 583 | SEQ ID NO: 6482 | taccgaccctaacatcagg | 4162 | 4181 | 1 | 3 |
| SEQ ID NO: 5937 | ccctctatggcaatgagg | 590 | 609 | SEQ ID NO: 6483 | cctcgccgacctcatgggg | 727 | 746 | 1 | 3 |
| SEQ ID NO: 5938 | gagggcatgggtgggcag | 605 | 624 | SEQ ID NO: 6484 | ctgcggatctgttttcctc | 1180 | 1199 | 1 | 3 |
| SEQ ID NO: 5939 | agggcatgggtgggcagg | 606 | 625 | SEQ ID NO: 6485 | cctgctctttcaccaccct | 2370 | 2389 | 1 | 3 |
| SEQ ID NO: 5940 | aggatggctcctgtcaccc | 622 | 641 | SEQ ID NO: 6486 | gggtcagcggttgtctcct | 2459 | 2478 | 1 | 3 |
| SEQ ID NO: 5941 | gatggctcctgtcacccg | 624 | 643 | SEQ ID NO: 6487 | cggggcgcttacgacatc | 4261 | 4280 | 1 | 3 |
| SEQ ID NO: 5942 | tgtcacccgcggctcccg | 633 | 652 | SEQ ID NO: 6488 | cggggcgcgttccctgaca | 3688 | 3707 | 1 | 3 |
| SEQ ID NO: 5943 | gtcacccgcggctcccgg | 634 | 653 | SEQ ID NO: 6489 | ccggggcgcgttccctgac | 3687 | 3706 | 1 | 3 |
| SEQ ID NO: 5944 | gcggctcccggcctagttg | 642 | 661 | SEQ ID NO: 6490 | caacgtccggggaggccgc | 2935 | 2954 | 1 | 3 |
| SEQ ID NO: 5945 | ctcccggcctagttgggc | 646 | 665 | SEQ ID NO: 6491 | gccctgtcgaacactggag | 4439 | 4458 | 1 | 3 |
| SEQ ID NO: 5946 | ataccctcacatgcggcct | 711 | 730 | SEQ ID NO: 6492 | aggcaacattatcatgtat | 8839 | 8858 | 1 | 3 |
| SEQ ID NO: 5947 | ttccgctcgtcggcggccc | 750 | 769 | SEQ ID NO: 6493 | gggcaaagcacatgtggaa | 5625 | 5644 | 1 | 3 |
| SEQ ID NO: 5948 | cccctagggggcgctgcca | 767 | 786 | SEQ ID NO: 6494 | tggcaatgagggcatgggg | 598 | 617 | 1 | 3 |
| SEQ ID NO: 5949 | tgcaacagggaacctgccc | 832 | 851 | SEQ ID NO: 6495 | gggctcattcgtgcatgca | 3092 | 3111 | 1 | 3 |
| SEQ ID NO: 5950 | gcgtaacgcgtccggggta | 922 | 941 | SEQ ID NO: 6496 | taccaccacgagcttacgc | 2751 | 2770 | 1 | 3 |
| SEQ ID NO: 5951 | tcaagcattgtgtttgagg | 968 | 987 | SEQ ID NO: 6497 | cctctatgccccccttga | 7512 | 7531 | 1 | 3 |
| SEQ ID NO: 5952 | cccacgctcgcggccagga | 1070 | 1089 | SEQ ID NO: 6498 | tcctgtttaacatcttggg | 5763 | 5782 | 1 | 3 |
| SEQ ID NO: 5953 | cggccaggaatgctaccat | 1080 | 1099 | SEQ ID NO: 6499 | atggcatgcatgtcggccg | 5279 | 5298 | 1 | 3 |
| SEQ ID NO: 5954 | acgacaatacgacaccacg | 1106 | 1125 | SEQ ID NO: 6500 | cgtggggacaaccgatcgt | 1888 | 1907 | 1 | 3 |
| SEQ ID NO: 5955 | gggcggctgctctctgtctc | 1140 | 1159 | SEQ ID NO: 6501 | gagcaacttgaaaaagccc | 8921 | 8940 | 1 | 3 |
| SEQ ID NO: 5956 | cgtgggggacctctgcgga | 1168 | 1187 | SEQ ID NO: 6502 | tccgttgccggagcgcacg | 2615 | 2634 | 1 | 3 |
| SEQ ID NO: 5957 | agctgttcaccttctcgcc | 1206 | 1225 | SEQ ID NO: 6503 | ggcgacaatagagggagct | 3779 | 3798 | 1 | 3 |
| SEQ ID NO: 5958 | ctgttcaccttctcgcccc | 1208 | 1227 | SEQ ID NO: 6504 | ggggagacatatatcacag | 9282 | 9301 | 1 | 3 |
| SEQ ID NO: 5959 | ctgcaattgttcgatctac | 1249 | 1268 | SEQ ID NO: 6505 | gtaggactggcaggggcag | 4809 | 4828 | 1 | 3 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5960 | attgttcgatctaccccgg | 1254 | 1273 | SEQ ID NO: 6506 | ccggcccaaaaggcccaat | 3615 | 3634 | 1 | 3 |
| SEQ ID NO: 5961 | atctaccccggccacgcgt | 1262 | 1281 | SEQ ID NO: 6507 | acgccatggaccgggagat | 2766 | 2785 | 1 | 3 |
| SEQ ID NO: 5962 | cggccacgcgtcaggtcac | 1270 | 1289 | SEQ ID NO: 6508 | gtgatgctacttttttgccg | 1460 | 1479 | 1 | 3 |
| SEQ ID NO: 5963 | ccgcatggcctgggacatg | 1288 | 1307 | SEQ ID NO: 6509 | catggaaactactatgcgg | 3943 | 3962 | 1 | 3 |
| SEQ ID NO: 5964 | cgcagttactccggatccc | 1344 | 1363 | SEQ ID NO: 6510 | gggaacccaggaggatgcg | 8593 | 8612 | 1 | 3 |
| SEQ ID NO: 5965 | cccacaagccgtcatcgac | 1360 | 1379 | SEQ ID NO: 6511 | gtcgtcaccagcacctggg | 5306 | 5325 | 1 | 3 |
| SEQ ID NO: 5966 | ctggggagtcctggcgggc | 1396 | 1415 | SEQ ID NO: 6512 | gcccggagcgcatggccag | 1695 | 1714 | 1 | 3 |
| SEQ ID NO: 5967 | ggcgggccttgcctactat | 1408 | 1427 | SEQ ID NO: 6513 | atagaagaagcctgccgcc | 7865 | 7884 | 1 | 3 |
| SEQ ID NO: 5968 | tttgccggcgttgacgggc | 1472 | 1491 | SEQ ID NO: 6514 | gccccacattcggccaaa | 7888 | 7907 | 1 | 3 |
| SEQ ID NO: 5969 | caccctcacaacgggggggg | 1492 | 1511 | SEQ ID NO: 6515 | ccccaatatcgaggaggtg | 4420 | 4439 | 1 | 3 |
| SEQ ID NO: 5970 | ggggggcacgctgcccgc | 1504 | 1523 | SEQ ID NO: 6516 | gcggcacggcgaccgcccc | 7440 | 7459 | 1 | 3 |
| SEQ ID NO: 5971 | ggggcacgctgcccgcctc | 1507 | 1526 | SEQ ID NO: 6517 | gagggagcttgctctcccc | 3789 | 3808 | 1 | 3 |
| SEQ ID NO: 5972 | gcccgcctcaccagcgggt | 1517 | 1536 | SEQ ID NO: 6518 | accctcacaacggggggc | 1493 | 1512 | 1 | 3 |
| SEQ ID NO: 5973 | atccagcttataaacacca | 1571 | 1590 | SEQ ID NO: 6519 | tggttatcgtgggtaggat | 5382 | 5401 | 1 | 3 |
| SEQ ID NO: 5974 | ctccagactgggtttcttg | 1637 | 1656 | SEQ ID NO: 6520 | caagcggagacggctggag | 4346 | 4365 | 1 | 3 |
| SEQ ID NO: 5975 | cccggagcgcatggccagc | 1696 | 1715 | SEQ ID NO: 6521 | gctgtgggcgtcttccggg | 3869 | 3888 | 1 | 3 |
| SEQ ID NO: 5976 | ctgccgctccattgacaag | 1714 | 1733 | SEQ ID NO: 6522 | cttggtacatcaagggcag | 2667 | 2686 | 1 | 3 |
| SEQ ID NO: 5977 | aagttcgaccagggatggg | 1730 | 1749 | SEQ ID NO: 6523 | cccaaccagaatacgactt | 8673 | 8692 | 1 | 3 |
| SEQ ID NO: 5978 | ggggtcctatcacttatgc | 1746 | 1765 | SEQ ID NO: 6524 | gcatgtgtgggttcccccc | 2914 | 2933 | 1 | 3 |
| SEQ ID NO: 5979 | ccagaggccttattgctgg | 1786 | 1805 | SEQ ID NO: 6525 | ccaggatctcgtcggctgg | 3658 | 3677 | 1 | 3 |
| SEQ ID NO: 5980 | cccacctcaacaatgtggt | 1810 | 1829 | SEQ ID NO: 6526 | accaagatcatcacctggg | 3284 | 3303 | 1 | 3 |
| SEQ ID NO: 5981 | tcgtacctgcgtcgcaggt | 1830 | 1849 | SEQ ID NO: 6527 | accttcaccattgagacga | 4748 | 4767 | 1 | 3 |
| SEQ ID NO: 5982 | tgcgtcgcaggtgtgtggt | 1837 | 1856 | SEQ ID NO: 6528 | accatgtctcccccacgca | 6123 | 6142 | 1 | 3 |
| SEQ ID NO: 5983 | tggggacaaccgatcgtct | 1890 | 1909 | SEQ ID NO: 6529 | agacgacgaccgtgcccca | 4761 | 4780 | 1 | 3 |
| SEQ ID NO: 5984 | cagctggggggagaacgat | 1924 | 1943 | SEQ ID NO: 6530 | atcggagctcagcccgctg | 2320 | 2339 | 1 | 3 |
| SEQ ID NO: 5985 | cgccgcaaggcaactggtt | 1974 | 1993 | SEQ ID NO: 6531 | aacccaggaggatgcggcg | 8596 | 8615 | 1 | 3 |
| SEQ ID NO: 5986 | gccgcaaggcaactggttc | 1975 | 1994 | SEQ ID NO: 6532 | gaacccaggaggatgcggc | 8595 | 8614 | 1 | 3 |
| SEQ ID NO: 5987 | ctgtacatggatgaatagc | 1996 | 2015 | SEQ ID NO: 6533 | gctataaaatcgctcacag | 8366 | 8385 | 1 | 3 |
| SEQ ID NO: 5988 | tgtacatggatgaatagca | 1997 | 2016 | SEQ ID NO: 6534 | tgctgctcaatgtcctaca | 7607 | 7626 | 1 | 3 |
| SEQ ID NO: 5989 | gttcaccaagacgtgcggg | 2020 | 2039 | SEQ ID NO: 6535 | cccgctcaccacccagaac | 5740 | 5759 | 1 | 3 |
| SEQ ID NO: 5990 | agacgtgcggggcccccc | 2028 | 2047 | SEQ ID NO: 6536 | ggggaggttcaagtggtct | 3512 | 3531 | 1 | 3 |
| SEQ ID NO: 5991 | cccccgtgtaacatcgggg | 2042 | 2061 | SEQ ID NO: 6537 | ccccaatcgatgaacgggg | 9376 | 9395 | 1 | 3 |
| SEQ ID NO: 5992 | taacaccttgacctgcccc | 2071 | 2090 | SEQ ID NO: 6538 | ggggacgaccttgtcgtta | 8561 | 8580 | 1 | 3 |
| SEQ ID NO: 5993 | ggctctggcactacccctg | 2184 | 2203 | SEQ ID NO: 6539 | caggaggatgcggcgagcc | 8600 | 8619 | 1 | 3 |
| SEQ ID NO: 5994 | tgcactgtcaacttctcca | 2201 | 2220 | SEQ ID NO: 6540 | tggatggggtgcggttgca | 6717 | 6736 | 1 | 3 |
| SEQ ID NO: 5995 | caggcttaatgctgcatgc | 2257 | 2276 | SEQ ID NO: 6541 | gcatcatgcacaccacctg | 6411 | 6430 | 1 | 3 |
| SEQ ID NO: 5996 | aatgctgcatgcaactgga | 2264 | 2283 | SEQ ID NO: 6542 | tccatggtcttagcgcatt | 9009 | 9028 | 1 | 3 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 5997 | ctgcatgcaactggacccg | 2268 | 2287 | SEQ ID NO: 6543 | cgggaccttgcggtagcag | 3236 | 3255 | 1 | 3 |
| SEQ ID NO: 5998 | caactggacccgaggagag | 2275 | 2294 | SEQ ID NO: 6544 | ctcttacgggatgaggttg | 6761 | 6780 | 1 | 3 |
| SEQ ID NO: 5999 | gacagggacagatcggagc | 2309 | 2328 | SEQ ID NO: 6545 | gctctcccccaggcctgtc | 3799 | 3818 | 1 | 3 |
| SEQ ID NO: 6000 | gacagatcggagctcagcc | 2315 | 2334 | SEQ ID NO: 6546 | ggctggagcgcggcttgtc | 4357 | 4376 | 1 | 3 |
| SEQ ID NO: 6001 | acagatcggagctcagccc | 2316 | 2335 | SEQ ID NO: 6547 | gggccaacgcccctgctgt | 5201 | 5220 | 1 | 3 |
| SEQ ID NO: 6002 | actggcttgatccacctcc | 2402 | 2421 | SEQ ID NO: 6548 | ggagagggggccgtgcagt | 6068 | 6087 | 1 | 3 |
| SEQ ID NO: 6003 | ggcttgatccacctccatc | 2405 | 2424 | SEQ ID NO: 6549 | gatgatgctgctgatagcc | 2551 | 2570 | 1 | 3 |
| SEQ ID NO: 6004 | gtcagcggttgtctccttt | 2461 | 2480 | SEQ ID NO: 6550 | aaaggacggttgtcctgac | 7344 | 7363 | 1 | 3 |
| SEQ ID NO: 6005 | gagtatgtcgtgttgctTT | 2492 | 2511 | SEQ ID NO: 6551 | aaagaccaagctcaaactc | 9202 | 9221 | 1 | 3 |
| SEQ ID NO: 6006 | tgtggatgatgctgctgat | 2547 | 2566 | SEQ ID NO: 6552 | atcactgatggcattcaca | 5707 | 5726 | 1 | 3 |
| SEQ ID NO: 6007 | ccgaggccgccttagagaa | 2574 | 2593 | SEQ ID NO: 6553 | ttctgattgccatactcgg | 3015 | 3034 | 1 | 3 |
| SEQ ID NO: 6008 | agaacctggtggccctcaa | 2589 | 2608 | SEQ ID NO: 6554 | ttgatatcaccaaacttct | 3000 | 3019 | 1 | 3 |
| SEQ ID NO: 6009 | tacatcaagggcaggctgg | 2672 | 2691 | SEQ ID NO: 6555 | ccagatgtacactaatgta | 3637 | 3656 | 1 | 3 |
| SEQ ID NO: 6010 | caagggcaggctggtccct | 2677 | 2696 | SEQ ID NO: 6556 | aggggtaggcatctacttg | 9355 | 9374 | 1 | 3 |
| SEQ ID NO: 6011 | gcatggccgctgctcctgc | 2720 | 2739 | SEQ ID NO: 6557 | gcagtgctcacttccatgc | 6848 | 6867 | 1 | 3 |
| SEQ ID NO: 6012 | catggccgctgctcctgct | 2721 | 2740 | SEQ ID NO: 6558 | agcagtgctcacttccatg | 6847 | 6866 | 1 | 3 |
| SEQ ID NO: 6013 | gccgctgctcctgctcctc | 2725 | 2744 | SEQ ID NO: 6559 | gagggccgccacttgcggc | 9160 | 9179 | 1 | 3 |
| SEQ ID NO: 6014 | ggagatggctgcatcgtgc | 2779 | 2798 | SEQ ID NO: 6560 | gcacggcgaccgcccctcc | 7443 | 7462 | 1 | 3 |
| SEQ ID NO: 6015 | atggctgcatcgtgcggag | 2783 | 2802 | SEQ ID NO: 6561 | ctccaggccaataggccat | 9404 | 9423 | 1 | 3 |
| SEQ ID NO: 6016 | ggcgcggtttttgtgggtc | 2801 | 2820 | SEQ ID NO: 6562 | gaccattaccacgggcgcc | 4192 | 4211 | 1 | 3 |
| SEQ ID NO: 6017 | tcttatcaccagagctgag | 2887 | 2906 | SEQ ID NO: 6563 | ctcacaggccgggacaaga | 3482 | 3501 | 1 | 3 |
| SEQ ID NO: 6018 | gtgtgggttcccccctca | 2918 | 2937 | SEQ ID NO: 6564 | tgaggtcaccctcacacac | 5242 | 5261 | 1 | 3 |
| SEQ ID NO: 6019 | tccccccctcaacgtccgg | 2926 | 2945 | SEQ ID NO: 6565 | ccggctcgtggctgaggga | 6261 | 6280 | 1 | 3 |
| SEQ ID NO: 6020 | ctcaacgtccggggaggcc | 2933 | 2952 | SEQ ID NO: 6566 | ggcctgttactccattgag | 8959 | 8978 | 1 | 3 |
| SEQ ID NO: 6021 | accaaacttctgattgcca | 3008 | 3027 | SEQ ID NO: 6567 | tggctctctacgatgtggt | 8130 | 8149 | 1 | 3 |
| SEQ ID NO: 6022 | caaacttctgattgccata | 3010 | 3029 | SEQ ID NO: 6568 | tatgacacccgctgttttg | 8267 | 8286 | 1 | 3 |
| SEQ ID NO: 6023 | ggaccgctcatggtgctcc | 3032 | 3051 | SEQ ID NO: 6569 | ggagatcctgcggaagtcc | 7171 | 7190 | 1 | 3 |
| SEQ ID NO: 6024 | gaccgctcatggtgctcca | 3033 | 3052 | SEQ ID NO: 6570 | tggaaactactatgcggtc | 3945 | 3964 | 1 | 3 |
| SEQ ID NO: 6025 | atgcatgttagtgcggaaa | 3106 | 3125 | SEQ ID NO: 6571 | tttctgtaggggtaggcat | 9348 | 9367 | 1 | 3 |
| SEQ ID NO: 6026 | ttatgtccaaatggccttc | 3139 | 3158 | SEQ ID NO: 6572 | gaagccagacaggctataa | 8354 | 8373 | 1 | 3 |
| SEQ ID NO: 6027 | ccaaatggccttcatgaga | 3145 | 3164 | SEQ ID NO: 6573 | tctcagcgacgggtcttgg | 7552 | 7571 | 1 | 3 |
| SEQ ID NO: 6028 | ccttcatgagactgggcgc | 3153 | 3172 | SEQ ID NO: 6574 | gcgctcgtggccttcaagg | 5927 | 5946 | 1 | 3 |
| SEQ ID NO: 6029 | ccttgcggtagcagtggag | 3241 | 3260 | SEQ ID NO: 6575 | ctccgcccgaaggggaagg | 3349 | 3368 | 1 | 3 |
| SEQ ID NO: 6030 | tgtcgtcttctctgacatg | 3262 | 3281 | SEQ ID NO: 6576 | catggtctacgccacgaca | 7717 | 7736 | 1 | 3 |
| SEQ ID NO: 6031 | tgggggcagacaccgcgg | 3299 | 3318 | SEQ ID NO: 6577 | ccgccttatcgtattccca | 8083 | 8102 | 1 | 3 |
| SEQ ID NO: 6032 | gggggggcagacaccgcggc | 3300 | 3319 | SEQ ID NO: 6578 | gccgcccaactcgctcccc | 5792 | 5811 | 1 | 3 |
| SEQ ID NO: 6033 | gtggggacatcatcctggg | 3321 | 3340 | SEQ ID NO: 6579 | cccatctacacgctcccac | 4020 | 4039 | 1 | 3 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 6034 | tggggacatcatcctgggc | 3322 | 3341 | SEQ ID NO: 6580 | gcccatctacacgctccca | 4019 | 4038 | 1 | 3 |
| SEQ ID NO: 6035 | ggggacatcatcctgggcc | 3323 | 3342 | SEQ ID NO: 6581 | ggccaggggtctcccccc | 6913 | 6932 | 1 | 3 |
| SEQ ID NO: 6036 | acctgtctccgcccgaagg | 3343 | 3362 | SEQ ID NO: 6582 | cctttgacagactgcaggt | 7770 | 7789 | 1 | 3 |
| SEQ ID NO: 6037 | tgtctccgcccgaagggga | 3346 | 3365 | SEQ ID NO: 6583 | tccccggtcttcacagaca | 3962 | 3981 | 1 | 3 |
| SEQ ID NO: 6038 | gggagatactcctggggcc | 3366 | 3385 | SEQ ID NO: 6584 | ggcccatctacacgctccc | 4018 | 4037 | 1 | 3 |
| SEQ ID NO: 6039 | ctcccaacagacccggggc | 3439 | 3458 | SEQ ID NO: 6585 | gccccccttgaggggggag | 7519 | 7538 | 1 | 3 |
| SEQ ID NO: 6040 | tccaccgcaacacaatctt | 3530 | 3549 | SEQ ID NO: 6586 | aagaggctccaccagtgga | 6215 | 6234 | 1 | 3 |
| SEQ ID NO: 6041 | cacaatctttcctggcgac | 3540 | 3559 | SEQ ID NO: 6587 | gtcgtcggagtcgtgtgtg | 6020 | 6039 | 1 | 3 |
| SEQ ID NO: 6042 | ggctggccggcgccccccg | 3671 | 3690 | SEQ ID NO: 6588 | cgggttgttgcaaacagcc | 5542 | 5561 | 1 | 3 |
| SEQ ID NO: 6043 | ccccggggcgcgttccctg | 3685 | 3704 | SEQ ID NO: 6589 | caggtttgtaactccgggg | 4840 | 4859 | 1 | 3 |
| SEQ ID NO: 6044 | tccctgacaccatgcacct | 3698 | 3717 | SEQ ID NO: 6590 | aggtcacgcgggtggggga | 6618 | 6637 | 1 | 3 |
| SEQ ID NO: 6045 | ttccggtgcgccggcgggg | 3762 | 3781 | SEQ ID NO: 6591 | ccccgttgagtccatggaa | 3931 | 3950 | 1 | 3 |
| SEQ ID NO: 6046 | ctcccccaggcctgtctcc | 3802 | 3821 | SEQ ID NO: 6592 | ggagacatcgggccaggag | 9111 | 9130 | 1 | 3 |
| SEQ ID NO: 6047 | gggggttgcaaaggcggtg | 3904 | 3923 | SEQ ID NO: 6593 | caccctgcctgggaacccc | 5680 | 5699 | 1 | 3 |
| SEQ ID NO: 6048 | tttgtcccgttgagtcca | 3926 | 3945 | SEQ ID NO: 6594 | tggagaccttctgggcaaa | 5613 | 5632 | 1 | 3 |
| SEQ ID NO: 6049 | ccgtaccgcaaacattcca | 3996 | 4015 | SEQ ID NO: 6595 | tggattgccaaatctacgg | 8940 | 8959 | 1 | 3 |
| SEQ ID NO: 6050 | caagtggcccatctacacg | 4013 | 4032 | SEQ ID NO: 6596 | cgtgggtaggatcatcttg | 5389 | 5408 | 1 | 3 |
| SEQ ID NO: 6051 | cacgctcccactggcagcg | 4028 | 4047 | SEQ ID NO: 6597 | cgctgcttcggctttcgtg | 5815 | 5834 | 1 | 3 |
| SEQ ID NO: 6052 | ccgcatatgcgggcccaagg | 4068 | 4087 | SEQ ID NO: 6598 | ccttcaaggtcatgagcgg | 5937 | 5956 | 1 | 3 |
| SEQ ID NO: 6053 | cgtatatgtctaaagcaca | 4140 | 4159 | SEQ ID NO: 6599 | tgtggaagtgtctcatacg | 5163 | 5182 | 1 | 3 |
| SEQ ID NO: 6054 | gtatatgtctaaagcacat | 4141 | 4160 | SEQ ID NO: 6600 | atgtggaagtgtctcatac | 5162 | 5181 | 1 | 3 |
| SEQ ID NO: 6055 | ggaccattaccacgggcgc | 4191 | 4210 | SEQ ID NO: 6601 | gcgcgtgtcactcaggtcc | 6167 | 6186 | 1 | 3 |
| SEQ ID NO: 6056 | cccccattacgtactccac | 4209 | 4228 | SEQ ID NO: 6602 | gtgggcccgggagaggggg | 6059 | 6078 | 1 | 3 |
| SEQ ID NO: 6057 | agttccttgccgacggtgg | 4236 | 4255 | SEQ ID NO: 6603 | ccacagtcaaggctaaact | 7839 | 7858 | 1 | 3 |
| SEQ ID NO: 6058 | gagacggctggagcgcggc | 4352 | 4371 | SEQ ID NO: 6604 | gccggggaccccgatctc | 7537 | 7556 | 1 | 3 |
| SEQ ID NO: 6059 | caccgctacgcctccagga | 4384 | 4403 | SEQ ID NO: 6605 | tcctacacatggacaggtg | 7619 | 7638 | 1 | 3 |
| SEQ ID NO: 6060 | tggagagatcccttctac | 4453 | 4472 | SEQ ID NO: 6606 | gtagcagtgctcacttcca | 6845 | 6864 | 1 | 3 |
| SEQ ID NO: 6061 | agccatcccatcgaagcc | 4477 | 4496 | SEQ ID NO: 6607 | ggctggttcgttgctggct | 9257 | 9276 | 1 | 3 |
| SEQ ID NO: 6062 | tccccatcgaagccatcaa | 4482 | 4501 | SEQ ID NO: 6608 | ttgaggggagccgggga | 7527 | 7546 | 1 | 3 |
| SEQ ID NO: 6063 | ccccatcgaagccatcaag | 4483 | 4502 | SEQ ID NO: 6609 | cttgaggggagccggggg | 7526 | 7545 | 1 | 3 |
| SEQ ID NO: 6064 | ggcctcggaatcaatgctg | 4568 | 4587 | SEQ ID NO: 6610 | cagctccgaattgtcggcc | 7414 | 7433 | 1 | 3 |
| SEQ ID NO: 6065 | gtccgtcataccgaccagc | 4612 | 4631 | SEQ ID NO: 6611 | gctgagggatgtttgggac | 6271 | 6290 | 1 | 3 |
| SEQ ID NO: 6066 | gtcataccgaccagcggag | 4616 | 4635 | SEQ ID NO: 6612 | ctccattgagccacttgac | 8968 | 8987 | 1 | 3 |
| SEQ ID NO: 6067 | cgggctataccggtgactt | 4668 | 4687 | SEQ ID NO: 6613 | aagtccaagaagttccccg | 7184 | 7203 | 1 | 3 |
| SEQ ID NO: 6068 | cttttgattcagtgatcgac | 4684 | 4703 | SEQ ID NO: 6614 | gtcgagttcctggtaaaag | 8213 | 8232 | 1 | 3 |
| SEQ ID NO: 6069 | acagtcgacttcagcttgg | 4724 | 4743 | SEQ ID NO: 6615 | ccaaatctacggggcctgt | 8947 | 8966 | 1 | 3 |
| SEQ ID NO: 6070 | cttggaccccaccttcacc | 4738 | 4757 | SEQ ID NO: 6616 | ggtgttgagtgacttcaag | 6301 | 6320 | 1 | 3 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 6071 | gagacgacgaccgtgcccc | 4760 | 4779 | SEQ ID NO: 6617 | ggggacaaccgatcgtctc | 1891 | 1910 | 1 | 3 |
| SEQ ID NO: 6072 | ggggtaggactggcagggg | 4806 | 4825 | SEQ ID NO: 6618 | cccccggggacttgcccc | 8657 | 8676 | 1 | 3 |
| SEQ ID NO: 6073 | gggcatatacaggtttgta | 4831 | 4850 | SEQ ID NO: 6619 | tacacatggacaggtgccc | 7622 | 7641 | 1 | 3 |
| SEQ ID NO: 6074 | gggggaacggccctcgggc | 4855 | 4874 | SEQ ID NO: 6620 | gcccctgcacgccttcccc | 6546 | 6565 | 1 | 3 |
| SEQ ID NO: 6075 | tgacgcgggctgtgcttgg | 4906 | 4925 | SEQ ID NO: 6621 | ccaattgacaccaccgtca | 8009 | 8028 | 1 | 3 |
| SEQ ID NO: 6076 | gacgcgggctgtgcttggt | 4907 | 4926 | SEQ ID NO: 6622 | accaattgacaccaccgtc | 8008 | 8027 | 1 | 3 |
| SEQ ID NO: 6077 | tgcttggtacgagctcacc | 4918 | 4937 | SEQ ID NO: 6623 | ggtgcggctgttggcagca | 5849 | 5868 | 1 | 3 |
| SEQ ID NO: 6078 | tgcccacttcctgtcccag | 5050 | 5069 | SEQ ID NO: 6624 | ctgggcgcgctgacgggca | 3164 | 3183 | 1 | 3 |
| SEQ ID NO: 6079 | ggtggcataccaagccaca | 5101 | 5120 | SEQ ID NO: 6625 | tgtgacaccaattgacacc | 8002 | 8021 | 1 | 3 |
| SEQ ID NO: 6080 | gggctcaggccccacctcc | 5130 | 5149 | SEQ ID NO: 6626 | ggaggccgcaagccagccc | 8066 | 8085 | 1 | 3 |
| SEQ ID NO: 6081 | ccatcgtgggatcaaatgt | 5147 | 5166 | SEQ ID NO: 6627 | acattctggcgggctatgg | 5892 | 5911 | 1 | 3 |
| SEQ ID NO: 6082 | tcatacggctaaaacccac | 5175 | 5194 | SEQ ID NO: 6628 | gtggccttcaaggtcatga | 5933 | 5952 | 1 | 3 |
| SEQ ID NO: 6083 | tgctgtataggctagggggc | 5214 | 5233 | SEQ ID NO: 6629 | gcccgaaccggacgtagca | 6832 | 6851 | 1 | 3 |
| SEQ ID NO: 6084 | ccaaatacatcatggcatg | 5268 | 5287 | SEQ ID NO: 6630 | catgcctcaggaaacttgg | 9072 | 9091 | 1 | 3 |
| SEQ ID NO: 6085 | ggagtcctcgcagctctgg | 5336 | 5355 | SEQ ID NO: 6631 | ccagctgtctgcgccctcc | 6955 | 6974 | 1 | 3 |
| SEQ ID NO: 6086 | gcctgacaacaggcagtgt | 5364 | 5383 | SEQ ID NO: 6632 | acactccaggccaataggc | 9401 | 9420 | 1 | 3 |
| SEQ ID NO: 6087 | agccaccaagcaggcggag | 5557 | 5576 | SEQ ID NO: 6633 | ctccagttaactcctggct | 8820 | 8839 | 1 | 3 |
| SEQ ID NO: 6088 | catgtggaatttcatcagc | 5635 | 5654 | SEQ ID NO: 6634 | gctgcgccatcacaacatg | 7702 | 7721 | 1 | 3 |
| SEQ ID NO: 6089 | ctctatcaccagcccgctc | 5728 | 5747 | SEQ ID NO: 6635 | gagccgcatgactgcagag | 9565 | 9584 | 1 | 3 |
| SEQ ID NO: 6090 | cccagaacaccctcctgtt | 5751 | 5770 | SEQ ID NO: 6636 | aacatcttggggggtggg | 5771 | 5790 | 1 | 3 |
| SEQ ID NO: 6091 | ctcctgtttaacatcttgg | 5762 | 5781 | SEQ ID NO: 6637 | ccaatcgatgaacggggag | 9378 | 9397 | 1 | 3 |
| SEQ ID NO: 6092 | ttgggggggtgggtagccg | 5777 | 5796 | SEQ ID NO: 6638 | cggcgccaaactattccaa | 6564 | 6583 | 1 | 3 |
| SEQ ID NO: 6093 | tgcttcggctttcgtgggc | 5818 | 5837 | SEQ ID NO: 6639 | gcccgaaccggacgtagca | 6832 | 6851 | 1 | 3 |
| SEQ ID NO: 6094 | tcgtgggcgctggtatcgc | 5829 | 5848 | SEQ ID NO: 6640 | gcgagcggcgtgctgacga | 8453 | 8472 | 1 | 3 |
| SEQ ID NO: 6095 | cgctggtgcggctgttggc | 5845 | 5864 | SEQ ID NO: 6641 | gccacgacatcccgcagcg | 7727 | 7746 | 1 | 3 |
| SEQ ID NO: 6096 | cggctgttggcagcatagg | 5853 | 5872 | SEQ ID NO: 6642 | cctagactctttcgagccg | 7111 | 7130 | 1 | 3 |
| SEQ ID NO: 6097 | ggggcagggtggctggcg | 5909 | 5928 | SEQ ID NO: 6643 | cgcccaactcgctccccc | 5794 | 5813 | 1 | 3 |
| SEQ ID NO: 6098 | ctggcgcgctcgtggcctt | 5922 | 5941 | SEQ ID NO: 6644 | aagggaggccgcaagccag | 8063 | 8082 | 1 | 3 |
| SEQ ID NO: 6099 | tggcgcgctcgtggccttc | 5923 | 5942 | SEQ ID NO: 6645 | gaagggaggccgcaagcca | 8062 | 8081 | 1 | 3 |
| SEQ ID NO: 6100 | gagcggcgaggcgccctct | 5950 | 5969 | SEQ ID NO: 6646 | agagcgtcgtctgctgctc | 7596 | 7615 | 1 | 3 |
| SEQ ID NO: 6101 | tgggcccgggagaggggc | 6060 | 6079 | SEQ ID NO: 6647 | gcccatctacacgctccca | 4019 | 4038 | 1 | 3 |
| SEQ ID NO: 6102 | cggctgatagcgttcgctt | 6095 | 6114 | SEQ ID NO: 6648 | aagcaggcggaggctgccg | 5564 | 5583 | 1 | 3 |
| SEQ ID NO: 6103 | gtgcctgagagcgacgccg | 6146 | 6165 | SEQ ID NO: 6649 | cggccgccgacagcggcac | 7428 | 7447 | 1 | 3 |
| SEQ ID NO: 6104 | atgaggactgttctacgcc | 6237 | 6256 | SEQ ID NO: 6650 | ggcgggggacggcatcat | 6399 | 6418 | 1 | 3 |
| SEQ ID NO: 6105 | gtccaagctcctgccgcgg | 6331 | 6350 | SEQ ID NO: 6651 | ccgctccgtgtgggaggac | 7969 | 7988 | 1 | 3 |
| SEQ ID NO: 6106 | acagatcgccggacatgtc | 6442 | 6461 | SEQ ID NO: 6652 | gacatatatcacagcctgt | 9287 | 9306 | 1 | 3 |
| SEQ ID NO: 6107 | acgtggcatggaacattcc | 6506 | 6525 | SEQ ID NO: 6653 | ggaagaacccggactacgt | 7257 | 7276 | 1 | 3 |

TABLE 13-continued

Selected palindromic sequences from human hepatitis C virus (HCV)

| Source | | Start Index | End Index | Match | | Start Index | End Index | # | B |
|---|---|---|---|---|---|---|---|---|---|
| SEQ ID NO: 6108 | gggcccctgcacgccttcc | 6544 | 6563 | SEQ ID NO: 6654 | ggaagaaagcaagctgccc | 7660 | 7679 | 1 | 3 |
| SEQ ID NO: 6109 | agtgcccatgtcaggttcc | 6675 | 6694 | SEQ ID NO: 6655 | ggaaacagctagacacact | 8803 | 8822 | 1 | 3 |
| SEQ ID NO: 6110 | tgcccatgtcaggttccag | 6677 | 6696 | SEQ ID NO: 6656 | ctgggcgcgctgacgggca | 3164 | 3183 | 1 | 3 |
| SEQ ID NO: 6111 | cagctcctgagtttttcac | 6693 | 6712 | SEQ ID NO: 6657 | gtgagagcgtcgtctgctg | 7593 | 7612 | 1 | 3 |
| SEQ ID NO: 6112 | tcacggaggtggatggggt | 6708 | 6727 | SEQ ID NO: 6658 | acccttcctcaagccgtga | 8153 | 8172 | 1 | 3 |
| SEQ ID NO: 6113 | cacggaggtggatgggtg | 6709 | 6728 | SEQ ID NO: 6659 | caccccttcctcaagccgtg | 8152 | 8171 | 1 | 3 |
| SEQ ID NO: 6114 | gacccctcccacattacag | 6872 | 6891 | SEQ ID NO: 6660 | ctgttttgactcaacggtc | 8278 | 8297 | 1 | 3 |
| SEQ ID NO: 6115 | ttggccaggggggtctcccc | 6911 | 6930 | SEQ ID NO: 6661 | ggggtgggtagccgcccaa | 5782 | 5801 | 1 | 3 |
| SEQ ID NO: 6116 | ccttgagggcgacatgcac | 6972 | 6991 | SEQ ID NO: 6662 | gtgcttaaggagatgaagg | 7811 | 7830 | 1 | 3 |
| SEQ ID NO: 6117 | ggagatgggcggaaacatc | 7060 | 7079 | SEQ ID NO: 6663 | gatgacccatttcttctcc | 8887 | 8906 | 1 | 3 |
| SEQ ID NO: 6118 | gagatgggcggaaacatca | 7061 | 7080 | SEQ ID NO: 6664 | tgatgacccatttcttctc | 8886 | 8905 | 1 | 3 |
| SEQ ID NO: 6119 | ctagactctttcgagccgc | 7112 | 7131 | SEQ ID NO: 6665 | gcggcgtgctgacgactag | 8457 | 8476 | 1 | 3 |
| SEQ ID NO: 6120 | tagactctttcgagccgct | 7113 | 7132 | SEQ ID NO: 6666 | agcgacgggtcttggtcta | 7556 | 7575 | 1 | 3 |
| SEQ ID NO: 6121 | agaatgaaatatccattgc | 7149 | 7168 | SEQ ID NO: 6667 | gcaaagaatgaggttttct | 8030 | 8049 | 1 | 3 |
| SEQ ID NO: 6122 | ttgcggcggagatcctgcg | 7164 | 7183 | SEQ ID NO: 6668 | cgcacgatgcatctggcaa | 8730 | 8749 | 1 | 3 |
| SEQ ID NO: 6123 | agcgaggaggctggtgaga | 7580 | 7599 | SEQ ID NO: 6669 | tctcgtgcccgacccgct | 9305 | 9324 | 1 | 3 |
| SEQ ID NO: 6124 | tgagagcgtcgtctgctgc | 7594 | 7613 | SEQ ID NO: 6670 | gcagtaaagaccaagctca | 9197 | 9216 | 1 | 3 |
| SEQ ID NO: 6125 | gtcgtctgctgctcaatgt | 7601 | 7620 | SEQ ID NO: 6671 | acatggtctacgccacgac | 7716 | 7735 | 1 | 3 |
| SEQ ID NO: 6126 | tgcgccatcacaacatggt | 7704 | 7723 | SEQ ID NO: 6672 | accatgtctcccccacgca | 6123 | 6142 | 1 | 3 |
| SEQ ID NO: 6127 | cagaagaaggtcacctttg | 7757 | 7776 | SEQ ID NO: 6673 | caaagaatgaggttttctg | 8031 | 8050 | 1 | 3 |
| SEQ ID NO: 6128 | cctggatgaccattaccgg | 7789 | 7808 | SEQ ID NO: 6674 | ccggaacctatccagcagg | 7936 | 7955 | 1 | 3 |
| SEQ ID NO: 6129 | ggacgtgcttaaggagatg | 7807 | 7826 | SEQ ID NO: 6675 | catcgggccaggagcgtcc | 9116 | 9135 | 1 | 3 |
| SEQ ID NO: 6130 | aaagaatgaggttttctgc | 8032 | 8051 | SEQ ID NO: 6676 | gcagaagaaggtcaccttt | 7756 | 7775 | 1 | 3 |
| SEQ ID NO: 6131 | agttcgtgtatgcgagaag | 8110 | 8129 | SEQ ID NO: 6677 | cttcatgcctcaggaaact | 9069 | 9088 | 1 | 3 |
| SEQ ID NO: 6132 | ggctataaaatcgctcaca | 8365 | 8384 | SEQ ID NO: 6678 | tgtgaaaggtccgtgagcc | 9551 | 9570 | 1 | 3 |
| SEQ ID NO: 6133 | ttctccatccttctagctc | 8900 | 8919 | SEQ ID NO: 6679 | gagcggaggggggatgagaa | 7134 | 7153 | 1 | 3 |
| SEQ ID NO: 6134 | tgtctcgtgcccgaccccg | 9303 | 9322 | SEQ ID NO: 6680 | cggggcgcgttccctgaca | 3688 | 3707 | 1 | 3 |

TABLE 14

Sequences from human hepatitis C virus (HCV) (Direct Match Type)

| Source | | Start Index | End Index | Match | | Start Index | End Index | Match # |
|---|---|---|---|---|---|---|---|---|
| SEQ ID NO: 4088 | tttttttttttttttttttt | 9446 | 9465 | SEQ ID NO: 4661 | tttttttttttttttttttt | 9466 | 9485 | 2 |
| SEQ ID NO: 4347 | tttttttttttttttttttt | 9446 | 9465 | SEQ ID NO: 5229 | tttttttttttttttttttt | 9465 | 9484 | 1 |
| SEQ ID NO: 4348 | tttttttttttttttttttt | 9447 | 9466 | SEQ ID NO: 5230 | tttttttttttttttttttt | 9466 | 9485 | 1 |

TABLE 15

Sequences of Exemplary Gene Targets gi|4502152|ref|NM_000384.1| *Homo sapiens* apolipoprotein B
(including Ag(x) antigen) (APOB), mRNA ATTCCCACCGGGACCTGCGGGGCTGAGTGCCCTTCTCGGTTGCTGCCGCTGAGGAGCCCGCCCAGCCAGC  (SEQ ID NO: 6681)

CAGGGCCGCGAGGCCGAGGCCAGGCCGCAGCCCAGGAGCCGCCCCACCGCAGCTGGCGATGGACCCGCCG

AGGCCCGCGCTGCTGGCGCTGCTGGCGCTGCCTGCGCTGCTGCTGCTGCTGGCGGGCGCCAGGGCCG

AAGAGGAAATGCTGGAAAATGTCAGCCTGGTCTGTCCAAAAGATGCGACCCGATTCAAGCACCTCCGGAA

GTACACATACAACTATGAGGCTGAGAGTTCCAGTGGAGTCCCTGGGACTGCTGATTCAAGAAGTGCCACC

AGGATCAACTGCAAGGTTGAGCTGGAGGTTCCCCAGCTCTGCAGCTTCATCCTGAAGACCAGCCAGTGCA

CCCTGAAAGAGGTGTATGGCTTCAACCCTGAGGGCAAAGCCTTGCTGAAGAAAACCAAGAACTCTGAGGA

GTTTGCTGCAGCCATGTCCAGGTATGAGCTCAAGCTGGCCATTCCAGAAGGGAAGCAGGTTTTCCTTTAC

CCGGAGAAAGATGAACCTACTTACATCCTGAACATCAAGAGGGGCATCATTTCTGCCCTCCTGGTTCCCC

CAGAGACAGAAGAAGCCAAGCAAGTGTTGTTTCTGGATACCGTGTATGGAAACTGCTCCACTCACTTTAC

CGTCAAGACGAGGAAGGGCAATGTGGCAACAGAAATATCCACTGAAAGAGACCTGGGGCAGTGTGATCGC

TTCAAGCCCATCCGCACAGGCATCAGCCCACTTGCTCTCATCAAAGGCATGACCCGCCCCTTGTCAACTC

TGATCAGCAGCAGCCAGTCCTGTCAGTACACACTGGACGCTAAGAGGAAGCATGTGGCAGAAGCCATCTG

CAAGGAGCAACACCTCTTCCTGCCTTTCTCCTACAACAATAAGTATGGGATGGTAGCACAAGTGACACAG

ACTTTGAAACTTGAAGACACACCAAAGATCAACAGCCGCTTCTTTGGTGAAGGTACTAAGAAGATGGGCC

TCGCATTTGAGAGCACCAAATCCACATCACCTCCAAAGCAGGCCGAAGCTGTTTTGAAGACTCTCCAGGA

ACTGAAAAAACTAACCATCTCTGAGCAAAATATCCAGAGAGCTAATCTCTTCAATAAGCTGGTTACTGAG

CTGAGAGGCCTCAGTGATGAAGCAGTCACATCTCTCTTGCCACAGCTGATTGAGGTGTCCAGCCCCATCA

CTTTACAAGCCTTGGTTCAGTGTGGACAGCCTCAGTGCTCCACTCACATCCTCCAGTGGCTGAAACGTGT

GCATGCCAACCCCCTTCTGATAGATGTGGTCACCTACCTGGTGGCCCTGATCCCCGAGCCCTCAGCACAG

CAGCTGCGAGAGATCTTCAACATGGCGAGGGATCAGCGCAGCCGAGCCACCTTGTATGCGCTGAGCCACG

CGGTCAACAACTATCATAAGCAAACCCTACAGGGACCCAGGAGCTGCTGGACATTGCTAATTACCTGAT

GGAACAGATTCAAGATGACTGCACTGGGGATGAAGATTACACCTATTTGATTCTGCGGGTCATTGGAAAT

ATGGGCCAAACCATGGAGCAGTTAACTCCAGAACTCAAGTCTTCAATCCTCAAATGTGTCCAAAGTACAA

AGCCATCACTGATGATCCAGAAAGCTGCCATCCAGGCTCTGCGGAAAATGGAGCCTAAAGACAAGGACCA

GGAGGTTCTTCTTCAGACTTTCCTTGATGATGCTTCTCCGGGAGATAAGCGACTGGCTGCCTATCTTATG

TTGATGAGGAGTCCTTCACAGGCAGATATTAACAAAATTGTCCAAATTCTACCATGGGAACAGAATGAGC

AAGTGAAGAACTTTGTGGCTTCCCATATTGCCAATATCTTGAACTCAGAAGAATTGGATATCCAAGATCT

GAAAAAGTTAGTGAAAGAAGCTCTGAAAGAATCTCAACTTCCAACTGTCATGGACTTCAGAAAATTCTCT

CGGAACTATCAACTCTACAAATCTGTTTCTCTTCCATCACTTGACCCAGCCTCAGCCAAAATAGAAGGGA

ATCTTATATTTGATCCAAATAACTACCTTCCTAAAGAAAGCATGCTGAAAACTACCCTCACTGCCTTTGG

ATTTGCTTCAGCTGACCTCATCGAGATTGGCTTGGAAGGAAAAGGCTTTGAGCCAACATTGGAAGCTCTT

TTTGGGAAGCAAGGATTTTTCCCAGACAGTGTCAACAAAGCTTTGTACTGGGTTAATGGTCAAGTTCCTG

ATGGTGTCTCTAAGGTCTTAGTGGACCACTTTGGCTATACCAAAGATGATAAACATGAGCAGGATATGGT

AAATGGAATAATGCTCAGTGTTGAGAAGCTGATTAAAGATTTGAAATCCAAAGAAGTCCCGGAAGCCAGA

GCCTACCTCCGCATCTTGGGAGAGGAGCTTGGTTTTGCCAGTCTCCATGACCTCCAGCTCCTGGGAAAGC

TGCTTCTGATGGGTGCCCGCACTCTGCAGGGGATCCCCCAGATGATTGGAGAGGTCATCAGGAAGGGCTC

AAAGAATGACTTTTTTCTTCACTACATCTTCATGGAGAATGCCTTTGAACTCCCCACTGGAGCTGGATTA

TABLE 15-continued

Sequences of Exemplary Gene Targets

CAGTTGCAAATATCTTCATCTGGAGTCATTGCTCCCGGAGCCAAGGCTGGAGTAAAACTGGAAGTAGCCA

ACATGCAGGCTGAACTGGTGGCAAAACCCTCCGTGTCTGTGGAGTTTGTGACAAATATGGGCATCATCAT

TCCGGACTTCGCTAGGAGTGGGGTCCAGATGAACACCAACTTCTTCCACGAGTCGGGTCTGGAGGCTCAT

GTTGCCCTAAAAGCTGGGAAGCTGAAGTTTATCATTCCTTCCCCAAAGAGACCAGTCAAGCTGCTCAGTG

GAGGCAACACATTACATTTGGTCTCTACCACCAAAACGGAGGTGATCCCACCTCTCATTGAGAACAGGCA

GTCCTGGTCAGTTTGCAAGCAAGTCTTTCCTGGCCTGAATTACTGCACCTCAGGCGCTTACTCCAACGCC

AGCTCCACAGACTCCGCCTCCTACTATCCGCTGACCGGGGACACCAGATTAGAGCTGGAACTGAGGCCTA

CAGGAGAGATTGAGCAGTATTCTGTCAGCGCAACCTATGAGCTCCAGAGAGAGGACAGAGCCTTGGTGGA

TACCCTGAAGTTTGTAACTCAAGCAGAAGGTGCGAAGCAGACTGAGGCTACCATGACATTCAAATATAAT

CGGCAGAGTATGACCTTGTCCAGTGAAGTCCAAATTCCGGATTTTGATGTTGACCTCGGAACAATCCTCA

GAGTTAATGATGAATCTACTGAGGGCAAAACGTCTTACAGACTCACCCTGGACATTCAGAACAAGAAAAT

TACTGAGGTCGCCCTCATGGGCCACCTAAGTTGTGACACAAAGGAAGAAAGAAAAATCAAGGGTGTTATT

TCCATACCCCGTTTGCAAGCAGAAGCCAGAAGTGAGATCCTCGCCCACTGGTCGCCTGCCAAACTGCTTC

TCCAAATGGACTCATCTGCTACAGCTTATGGCTCCACAGTTTCCAAGAGGGTGGCATGGCATTATGATGA

AGAGAAGATTGAATTTGAATGGAACACAGGCACCAATGTAGATACCAAAAAAATGACTTCCAATTTCCCT

GTGGATCTCTCCGATTATCCTAAGAGCTTGCATATGTATGCTAATAGACTCCTGGATCACAGAGTCCCTG

AAACAGACATGACTTTCCGGCACGTGGGTTCCAAATTAATAGTTGCAATGAGCTCATGGCTTCAGAAGGC

ATCTGGGAGTCTTCCTTATACCCAGACTTTGCAAGACCACCTCAATAGCCTGAAGGAGTTCAACCTCCAG

AACATGGGATTGCCAGACTTCCACATCCCAGAAAACCTCTTCTTAAAAAGCGATGGCCGGGTCAAATATA

CCTTGAACAAGAACAGTTTGAAAATTGAGATTCCTTTGCCTTTTGGTGGCAAATCCTCCAGAGATCTAAA

GATGTTAGAGACTGTTAGGACACCAGCCCTCCACTTCAAGTCTGTGGGATTCCATCTGCCATCTCGAGAG

TTCCAAGTCCCTACTTTTACCATTCCCAAGTTGTATCAACTGCAAGTGCCTCTCCTGGGTGTTCTAGACC

TCTCCACGAATGTCTACAGCAACTTGTACAACTGGTCCGCCTCCTACAGTGGTGGCAACACCAGCACAGA

CCATTTCAGCCTTCGGGCTCGTTACCACATGAAGGCTGACTCTGTGGTTGACCTGCTTTCCTACAATGTG

CAAGGATCTGGAGAACAACATATGACCACAAGAATACGTTCACACTATCATGTGATGGGTCTCTACGCC

ACAAATTTCTAGATTCGAATATCAAATTCAGTCATGTAGAAAAACTTGGAAACAACCCAGTCTCAAAGG

TTTACTAATATTCGATGCATCTAGTTCCTGGGGACCACAGATGTCTGCTTCAGTTCATTTGGACTCCAAA

AAGAAACAGCATTTGTTTGTCAAAGAAGTCAAGATTGATGGGCAGTTCAGAGTCTCTTCGTTCTATGCTA

AAGGCACATATGGCCTGTCTTGTCAGAGGGATCCTAACACTGGCCGGCTCAATGGAGAGTCCAACCTGAG

GTTTAACTCCTCCTACCTCCAAGGCACCAACCAGATAACAGGAAGATATGAAGATGGAACCCTCTCCCTC

ACCTCCACCTCTGATCTGCAAAGTGGCATCATTAAAAATACTGCTTCCCTAAAGTATGAGAACTACGAGC

TGACTTTAAAATCTGACACCAATGGGAAGTATAAGAACTTTGCCACTTCTAACAAGATGGATATGACCTT

CTCTAAGCAAAATGCACTGCTGCGTTCTGAATATCAGGCTGATTACGAGTCATTGAGGTTCTTCAGCCTG

CTTTCTGGATCACTAAATTCCCATGGTCTTGAGTTAAATGCTGACATCTTAGGCACTGACAAAATTAATA

GTGGTGCTCACAAGGCGACACTAAGGATTGGCCAAGATGGAATATCTACCAGTGCAACGACCAACTTGAA

GTGTAGTCTCCTGGTGCTGGAGAATGAGCTGAATGCAGAGCTTGGCCTCTCTGGGGCATCTATGAAATTA

ACAACAAATGGCCGCTTCAGGGAACACAATGCAAAATTCAGTCTGGATGGGAAAGCCGCCCTCACAGAGC

TATCACTGGGAAGTGCTTATCAGGCCATGATTCTGGGTGTCGACAGCAAAAACATTTTCAACTTCAAGGT

CAGTCAAGAAGGACTTAAGCTCTCAAATGACATGATGGGCTCATATGCTGAAATGAAATTTGACCACACA

TABLE 15-continued

Sequences of Exemplary Gene Targets

AACAGTCTGAACATTGCAGGCTTATCACTGGACTTCTCTTCAAAACTTGACAACATTTACAGCTCTGACA

AGTTTTATAAGCAAACTGTTAATTTACAGCTACAGCCCTATTCTCTGGTAACTACTTTAAACAGTGACCT

GAAATACAATGCTCTGGATCTCACCAACAATGGGAAACTACGGCTAGAACCCCTGAAGCTGCATGTGGCT

GGTAACCTAAAAGGAGCCTACCAAATAATGAAATAAAACACATCTATGCCATCTCTTCTGCTGCCTTAT

CAGCAAGCTATAAAGCAGACACTGTTGCTAAGGTTCAGGGTGTGGAGTTTAGCCATCGGCTCAACACAGA

CATCGCTGGGCTGGCTTCAGCCATTGACATGAGCACAAACTATAATTCAGACTCACTGCATTTCAGCAAT

GTCTTCCGTTCTGTAATGGCCCCGTTTACCATGACCATCGATGCACATACAAATGGCAATGGGAAACTCG

CTCTCTGGGGAGAACATACTGGGCAGCTGTATAGCAAATTCCTGTTGAAAGCAGAACCTCTGGCATTTAC

TTTCTCTCATGATTACAAAGGCTCCACAAGTCATCATCTCGTGTCTAGGAAAAGCATCAGTGCAGCTCTT

GAACACAAAGTCAGTGCCCTGCTTACTCCAGCTGAGCAGACAGGCACCTGGAAACTCAAGACCCAATTTA

ACAACAATGAATACAGCCAGGACTTGGATGCTTACAACACTAAAGATAAAATTGGCGTGGAGCTTACTGG

ACGAACTCTGGCTGACCTAACTCTACTAGACTCCCCAATTAAAGTGCCACTTTTACTCAGTGAGCCCATC

AATATCATTGATGCTTTAGAGATGAGAGATGCCGTTGAGAAGCCCCAAGAATTTACAATTGTTGCTTTTG

TAAAGTATGATAAAAACCAAGATGTTCACTCCATTAACCTCCCATTTTTTGAGACCTTGCAAGAATATTT

TGAGAGGAATCGACAAACCATTATAGTTGTAGTGGAAAACGTACAGAGAAACCTGAAGCACATCAATATT

GATCAATTTGTAAGAAAATACAGAGCAGCCCTGGGAAAACTCCCACAGCAAGCTAATGATTATCTGAATT

CATTCAATTGGGAGAGACAAGTTTCACATGCCAAGGAGAAACTGACTGCTCTCACAAAAAAGTATAGAAT

TACAGAAAATGATATACAAATTGCATTAGATGATGCCAAAATCAACTTTAATGAAAAACTATCTCAACTG

CAGACATATATGATACAATTTGATCAGTATATTAAAGATAGTTATGATTTACATGATTTGAAAATAGCTA

TTGCTAATATTATTGATGAAATCATTGAAAAATTAAAAAGTCTTGATGAGCACTATCATATCCGTGTAAA

TTTAGTAAAAACAATCCATGATCTACATTTGTTTATTGAAAATATTGATTTTAACAAAAGTGGAAGTAGT

ACTGCATCCTGGATTCAAAATGTGGATACTAAGTACCAAATCAGAATCCAGATACAAGAAAACTGCAGC

AGCTTAAGAGACACATACAGAATATAGACATCCAGCCACCTAGCTGGAAAGTTAAAACAACATTGAGGC

TATTGATGTTAGAGTGCTTTTAGATCAATTGGGAACTACAATTTCATTTGAAAGAATAAATGATGTTCTT

GAGCATGTCAAACACTTTGTTATAAATCTTATTGGGGATTTTGAAGTAGCTGAGAAAATCAATGCCTTCA

GAGCCAAAGTCCATGAGTTAATCGAGAGGTATGAAGTAGACCAACAAATCCAGGTTTTAATGGATAAATT

AGTAGAGTTGACCCACCAATACAAGTTGAAGGAGACTATTCAGAAGCTAAGCAATGTCCTACAACAAGTT

AAGATAAAAGATTACTTTGAGAAATTGGTTGGATTTATTGATGATGCTGTGAAGCTTAATGAATTAT

CTTTTAAAACATTCATTGAAGATGTTAACAAATTCCTTGACATGTTGATAAAGAAATTAAAGTCATTTGA

TTACCACCAGTTTGTAGATGAAACCAATGACAAAATCCGTGAGGTGACTCAGAGACTAATGGTGAAATT

CAGGCTCTGGAACTACCACAAAAAGCTGAAGCATTAAAACTGTTTTTAGAGGAAACCAAGGCCACAGTTG

CAGTGTATCTGGAAAGCCTACAGGACACCTAAAATAACCTTAATCATCAATTGGTTACAGGAGGCTTTAAG

TTCAGCATCTTTGGCTCACATGAAGGCCAAATTCCGAGAGACTCTAGAAGATACACGAGACCGAATGTAT

CAAATGGACATTCAGCAGGAACTTCAACGATACCTGTCTCTGGTAGGCCAGGTTTATAGCACACTTGTCA

CCTACATTTCTGATTGGTGGACTCTTGCTGCTAAGAACCTTACTGACTTTGCAGAGCAATATTCTATCCA

AGATTGGGCTAACGTATGAAAGCATTGGTAGAGCAAGGGTTCACTGTTCCTGAAATCAAGACCATCCTT

GGGACCATGCCTGCCTTTGAAGTCAGTCTTCAGGCTCTTCAGAAAGCTACCTTCCAGACACCTGATTTTA

TAGTCCCCCTAACAGATTTGAGGATTCCATCAGTTCAGATAAACTTCAAAGACTTAAAAAATATAAAAAT

CCCATCCAGGTTTTCCACACCAGAATTTACCATCCTTAACACCTTCCACATTCCTTCCTTTACAATTGAC

TABLE 15-continued

Sequences of Exemplary Gene Targets

```
TTTGTCGAAATGAAAGTGAAAGATCATCAGAACCATTGACCAGATGCAGAACAGTGAGCTGCAGTGGCCCG
TTCCAGATATATCTCAGGGATCTGAAGGTGGAGGACATTCCTCTAGCGAGAATCACCCTGCCAGACTT
CCGTTTACCAGAAATCGCAATTCCAGAATTCATAATCCCAACTCTCAACCTTAATGATTTTCAAGTTCCT
GACCTTCACATACCAGAATTCCAGCTTCCCCACATCTCACACACAATTGAAGTACCTACTTTTGGCAAGC
TATACAGTATTCTGAAAATCCAATCTCCTCTTTTCACATTAGATGCAAATGCTGACATAGGAATGGAAC
CACCTCAGCAAACGAAGCAGGTATCGCAGCTTCCATCACTGCCAAAGGAGAGTCCAAATTAGAAGTTCTC
AATTTTGATTTTCAAGCAAATGCACAACTCTCAAACCCTAAGATTAATCCGCTGGCTCTGAAGGAGTCAG
TGAAGTTCTCCAGCAGTACCTGAGAACGGAGCATGGGAGTGAAATGCTGTTTTTTGGAAATGCTATTGA
GGGAAAATCAAAICACAGTGGCAAGTTTACACACAGAAAAAAATACACTGGAGCTTAGTAATGGAGTGATT
GTCAAGATAAACAATCAGCTTACCCTGGATAGCAACACTAAATACTTCCACAAATTGAACATCCCCAAAC
TGGACTTCTCTAGTCAGGCTGACCTGCGCAACGAGATCAAGACACTGTTGAAAGCTGGCCACATAGCATG
GACTTCTTCTGGAAAAGGGTCATGGAAATGGGCCTGCCCCAGATTCTCAGATGAGGGAACACATGAATCA
CAAATTAGTTTCACCATAGAAGGACCCCTCACTTCCTTTGGACTGTCCAATAAGATCAATAGCAAACACC
TAAGAGTAAACCAAAACTTGGTTTATGAATCTGGCTCCCTCAACTTTTCTAAACTTGAAATTCAATCACA
AGTCGATTCCCAGCATGTGGGCCACAGTGTTCTAACTGCTAAAGGCATGGCACTGTTTGGAGAAGGAAG
GCAGAGTTTACTGGGAGGCATGATGCTCATTTAAATGGAAAGGTTATTGGAACTTTGAAAAATTCTCTTT
TCTTTTCAGCCCAGCCATTTGAGATCACGGCATCCACAAACAAATGAAGGGAATTTGAAAGTTCGTTTTCC
ATTAAGGTTAACAGGGAAGATAGACTTCCTGAATAACTATGCACTGTTTCTGAGTCCCAGTGCCCAGCAA
GCAAGTTGGCAAGTAAGTGCTAGGTTCAATCAGTATAAGTACAACCAAAATTTCTCTGCTGGAAACAACG
AGAACATTATGGAGGCCCATGTAGGAATAAATGGAGAAGCAAATCTGGATTTCTTAAACATTCCTTTAAC
AATTCCTGAAATGCGTCTACCTTACACAATAATCACAACTCCTCCACTGAAAGATTTCTCTCTATGGGAA
AAAACAGGCTTGAAGGAATTCTTGAAAACGACAAAGCAATCATTTGATTTAAGTGTAAAAGCTCAGTATA
AGAAAAACAAACACAGGCATTCCATCACAAATCCTTTGGCTGTGCTTTGTGAGTTTATCAGTCAGAGCAT
CAAATCCTTTGACAGGCATTTTGAAAAAAACAGAAACAATGCATTAGATTTTGTCACCAAATCCTATAAT
GAAACAAAAATTAAGTTTGATAAGTACAAAGCTGAAAAATCTCACGACGAGCTCCCCAGGACCTTTCAAA
TTCCTGGATACACTGTTCCAGTTGTCAATGTTGAAGTGTCTCCATTCACCATAGAGATGTCGGCATTCGG
CTATGTGTTCCCAAAAGCAGTCAGCATGCCTAGTTTCTCCATCCTAGGTTCTGACGTCCGTGTGCCTTCA
TACACATTAATCCTGCCATCATTAGAGCTGCCAGTCCTTCATGTCCCTAGAAATCTCAAGCTTTCTCTTC
CACATTTCAAGGAATTGTGTACCATAAGCCATATTTTTATTCCTGCCATGGGCATATTACCTATGATTT
CTCCTTTAAATCAAGTGTCATCACACTGAATACCAATGCTGAACTTTTTAACCAGTCAGATATTGTTGCT
CATCTCCTTTCTTCATCTTCATCTGTCATTGATGCACTGCAGTACAAATTAGAGGGCACCACAAGATTGA
CAAGAAAAGGGGATTGAAGTTAGCCACAGCTCTGTCTCTGAGCAACAAATTTGTGGAGGGTAGTCATAA
CAGTACTGTGAGCTTAACCACGAAAAATATGGAAGTGTCAGTGGCAAAAACCACAAAAGCCGAAATTCCA
ATTTTGAGAATGAATTTCAAGCAAGAACTTAATGGAAATACCAAGTCAAAACCTACTGTCTCTTCCTCCA
TGGAATTTAAGTATGATTTCAATTCTTCAATGCTGTACTCTACCGCTAAAGGAGCAGTTGACCACAAGCT
TAGCTTGGAAAGCCTCACCTCTTACTTTTCCATTGAGTCATCTACCAAAGGAGATGTCAAGGGTTCGGTT
CTTTCTCGGGAATATTCAGGAACTATTGCTAGTGAGGCCAACACTTACTTGAATTCCAAGAGCACACGGT
CTTCAGTGAAGCTGCAGGGCACTTCCAAAATTGATGATATCTGGAACCTTGAAGTAAAAGAAAATTTTGC
TGGAGAAGCCACACTCCAACGCATATATTCCCTCTGGGAGCACAGTACGAAAAACCACTTACAGCTAGAG
```

TABLE 15-continued

Sequences of Exemplary Gene Targets

```
GGCCTCTTTTTCACCAACGGAGAACATACAAGCAAAGCCACCCTGGAACTCTCTCCATGGCAAATGTCAG

CTCTTGTTCAGGTCCATGCAAGTCAGCCCAGTTCCTTCCATGATTTCCCTGACCTTGGCCAGGAAGTGGC

CCTGAATGCTAACACTAAGAACCAGAAGATCAGATGGAAAAATGAAGTCCGGATTCATTCTGGGTCTTTC

CAGAGCCAGGTCGAGCTTTCCAATGACCAAGAAAAGGCACACCTTGACATTGCAGGATCCTTAGAAGGAC

ACCTAAGGTTCCTCAAAAATATCATCCTACCAGTCTATGACAAGAGCTTATGGGATTTCCTAAAGCTGGA

TGTAACCACCAGCATTGGTAGGAGACAGCATCTTCGTGTTTCAACTGCCTTTGTGTACACCAAAAACCCC

AATGGCTATTCATTCTCCATCCCTGTAAAAGTTTTGGCTGATAAATTCATTACTCCTGGGCTGAAACTAA

ATGATCTAAATTCAGTTCTTGTCATGCCTACGTTCCATGTCCCATTTACAGATCTTCAGGTTCCATCGTG

CAAACTTGACTTCAGAGAAATACAAATCTATAAGAAGCTGAGAACTTCATCATTTGCCCTCAACCTACCA

ACACTCCCGAGGTAAAATTCCCTGAAGTTGATGTGTTAACAAAATATTCTCAACCAGAAGACTCCTTGA

TTCCCTTTTTTGAGATAACCGTGCCTGAATCTCAGTTAACTGTGTCCCAGTTCACGCTTCCAAAAAGTGT

TTCAGATGGCATTGCTGCTTTGGATCTAAATGCAGTAGCCAACAAGATCGCAGACTTTGAGTTGCCCACC

ATCATCGTGCCTGAGCAGACCATTGAGATTCCCTCCATTAAGTTCTCTGTACCTGCTGGAATTGTCATTC

CTTCCTTTCAAGCACTGACTGCACGCTTTGAGGTAGACTCTCCCGTGTATAATGCCACTTGGAGTGCCAG

TTTGAAAAACAAAGCAGATTATGTTGAAACAGTCCTGGATTCCACATGCAGCTCAACCGTACAGTTCCTA

GAATATGAACTAAATGTTTTGGGAACACACAAAATCGAAGATGGTACGTTAGCCTCTAAGACTAAAGGAA

CACTTGCACACCGTGACTTCAGTGCAGAATATGAAGAAGATGGCAAATTTGAAGGACTTCAGGAATGGGA

AGGAAAAGCGCACCTCAATATCAAAAGCCCAGCGTTCACCGATCTCCATCTGCGCTACCAGAAAGACAAG

AAAGGCATCTCCACCTCAGCAGCCTCCCCAGCCGTAGGCACCGTGGGCATGGATATGGATGAAGATGACG

ACTTTTCTAAATGGAACTTCTACTACAGCCCTCAGTCCTCTCCAGATAAAAAACTCACCATATTCAAAAC

TGAGTTGAGGGTCCGGGAATCTGATGAGGAAACTCAGATCAAAGTTAATTGGGAAGAAGAGGCAGCTTCT

GGCTTGCTAACCTCTCTGAAAGACAACGTGCCCAAGGCCACAGGGGTCCTTTATGATTATGTCAACAAGT

ACCACTGGGAACACACAGGGCTCACCCTGAGAGAAGTGTCTTCAAAGCTGAGAAGAAATCTGCAGAACAA

TGCTGAGTGGGTTTATCAAGGGGCCATTAGGCAAATTGATGATATCGACGTGAGGTTCCAGAAAGCAGCC

AGTGGCACCACTGGGACCTACCAAGAGTGGAAGGACAAGGCCCAGAATCTGTACCAGGAACTGTTGACTC

AGGAAGGCCAAGCCAGTTTCCAGGGACTCAAGGATAACGTGTTTGATGGCTTGGTACGAGTTACTCAAAA

ATTCCATATGAAAGTCAAGCATCTGATTGACTCACTCATTGATTTTCTGAACTTCCCCAGATTCCAGTTT

CCGGGGAAACCTGGGATATACACTAGGGAGGAACTTTGCACTATGTTCATAAGGGAGGTAGGGACGGTAC

TGTCCCAGGTATATTCGAAAGTCCATAATGGTTCAGAAATACTGTTTTCCTATTTCCAAGACCTAGTGAT

TACACTTCCTTTCGAGTTAAGGAAACATAAACTAATAGATGTAATCTCGATGTATAGGGAACTGTTGAAA

GATTTATCAAAAGAAGCCCAAGAGGTATTTAAAGCCATTCAGTCTCTCAAGACCACAGAGGTGCTACGTA

ATCTTCAGGACCTTTTACAATTCATTTTCCAACTAATAGAAGATAACATTAAACAGCTGAAAGAGATGAA

ATTTACTTATCTTATTAATTATATCCAAGATGAGATCAACACAATCTTCAATGATTATATCCCATATGTT

TTTAAATTGTTGAAAGAAAACCTATGCCTTAATCTTCATAAGTTCAATGAATTTATTCAAAACGAGCTTC

AGGAAGCTTCTCAAGAGTTACAGCAGATCCATCAATACATTATGGCCCTTCGTGAAGAATATTTTGATCC

AAGTATAGTTGGCTGGACAGTGAAATATTATGAACTTGAAGAAAAGATAGTCAGTCTGATCAAGAACCTG

TTAGTTGCTCTTAAGGACTTCCATTCTGAATATATTGTCAGTGCCTCTAACTTTACTTCCCAACTCTCAA

GTCAAGTTGAGCAATTTCTGCACAGAAATATTCAGGAATATCTTAGCATCCTTACCGATCCAGATGGAAA

AGGGAAAGAGAAGATTGCAGAGCTTTCTGCCACTGCTCAGGAAATAATTAAAAGCCAGGCCATTGCGACG
```

TABLE 15-continued

Sequences of Exemplary Gene Targets

AAGAAAATAATTTCTGATTACCACCAGCAGTTTAGATATAAACTGCAAGATTTTTCAGACCAACTCTCTG

ATTACTATGAAAAATTTATTGCTGAATCCAAAAGATTGATTGACCTGTCCATTCAAAACTACCACACATT

TCTGATATACATCACGGAGTTACTGAAAAAGCTGCAATCAACCACAGTCATGAACCCCTACATGAAGCTT

GCTCCAGGAGAACTTACTATCATCCTCTAATTTTTTAAAAGAAATCTTCATTTATTCTTCTTTTCCAATT

GAACTTTCACATAGCACAGAAAAAATTCAAACTGCCTATATTGATAAAACCATACAGTGAGCCAGCCTTG

CAGTAGGCAGTAGACTATAAGCAGAAGCACATATGAACTGGACCTGCACCAAAGCTGGCACCAGGGCTCG

GAAGGTCTCTGAACTCAGAAGGATGGCATTTTTTGCAAGTTAAAGAAAATCAGGATCTGAGTTATTTTGC

TAAACTTGGGGGAGGAGGAACAAATAAATGGAGTCTTTATTGTGTATCATA

>gi|4557442|ref|NM_000078.1| Homo sapiens
cholesteryl ester transfer protein, plasma (CETP), mRNA
GTGAATCTCTGGGGCCAGGAAGACCCTGCTGCCCGGAAGAGCCTCATGTTCCGTGGGGGCTGGGCGGACA        (SEQ ID NO: 6682)

TACATATACGGGCTCCAGGCTGAACGGCTCGGGCCACTTACACACCACTGCCTGATAACCATGCTGGCTG

CCACAGTCCTGACCCTGGCCCTGCTGGGCAATGCCCATGCCTGCTCCAAAGGCACCTCGCACGAGGCAGG

CATCGTGTGCCGCATCACCAAGCCTGCCCTCCTGGTGTTGAACCACGAGACTGCCAAGGTGATCCAGACC

GCCTTCCAGCGAGCCAGCTACCCAGATATCACGGGCGAGAAGGCCATGATGCTCCTTGGCCAAGTCAAGT

ATGGGTTGCACAACATCCAGATCAGCCACTTGTCCATCGCCAGCAGCCAGGTGGAGCTGGTGGAAGCCAA

GTCCATTGATGTCTCCATTCAGAACGTGTCTGTGGTCTTCAAGGGGACCCTGAAGTATGGCTACACCACT

GCCTGGTGGCTGGGTATTGATCAGTCCATTGACTTCGAGATCGACTCTGCCATTGACCTCCAGATCAACA

CACAGCTGACCTGTGACTCTGGTAGAGTGCGGACCGATGCCCCTGACTGCTACCTGTCTTTCCATAAGCT

GCTCCTGCATCTCCAAGGGGAGCGAGAGCCTGGGTGGATCAAGCAGCTGTTCACAAATTTCATCTCCTTC

ACCCTGAAGCTGGTCCTGAAGGGACAGATCTGCAAAGAGATCAACGTCATCTCTAACATCATGGCCGATT

TTGTCCAGACAAGGGCTGCCAGCATCCTTTCAGATGGAGACATTGGGGTGGACATTTCCCTGACAGGTGA

TCCCGTCATCACAGCCTCCTACCTGGAGTCCCATCACAAGGGTCATTTCATCTACAAGAATGTCTCAGAG

GACCTCCCCCTCCCCACCTTCTCGCCCACACTGCTGGGGGACTCCCGCATGCTGTACTTCTGGTTCTCTG

AGCGAGTCTTCCACTCGCTGGCCAAGGTAGCTTTCCAGGATGGCCGCCTCATGCTCAGCCTGATGGGAGA

CGAGTTCAAGGCAGTGCTGGAGACCTGGGGCTTCAACACCAACCAGGAAATCTTCCAAGAGGTTGTCGGC

GGCTTCCCCAGCCAGGCCCAAGTCACCGTCCACTGCCTCAAGATGCCCAAGATCTCCTGCCAAAACAAGG

GAGTCGTGGTCAATTCTTCAGTGATGGTGAAATTCCTCTTTCCACGCCCAGACCAGCAACATTCTGTAGC

TTACACATTTGAAGAGGATATCGTGACTACCGTCCAGGCCTCCTATTCTAAGAAAAAGCTCTTCTTAAGC

CTCTTGGATTTCCAGATTACACCAAAGACTGTTTCCAACTTGACTGAGAGCAGCTCCGAGTCCATCCAGA

GCTTCCTGCAGTCAATGATCACCGCTGTGGGCATCCCTGAGGTCATGTCTCGGCTCGAGGTAGTGTTTAC

AGCCCTCATGAACAGCAAAGGCGTGAGCCTCTTCGACATCATCAACCCTGAGATTATCACTCGAGATGGC

TTCCTGCTGCTGCAGATGGACTTTGGCTTCCCTGAGCACCTGCTGGTGGATTTCCTCCAGAGCTTGAGCT

AGAAGTCTCCAAGGAGGTCGGGATGGGGCTTGTAGCAGAAGGCAAGCACCAGGCTCACAGCTGGAACCCT

GGTGTCTCCTCCAGCGTGGTGGAAGTTGGGTTAGGAGTACGGAGATGGAGATTGGCTCCCAACTCCTCCC

TATCCTAAAGGCCCACTGGCATTAAAGTGCTGTATCCAAG

>gi|414668|emb|X75500.1|HSMTP H. sapiens mRNA for
microsomal triglyceride transfer protein
TGCAGTTGAGGATTGCTGGTCAATATGATTCTTCTTGCTGTGCTTTTTCTCTGCTTCATTTCCTCATATT        (SEQ ID NO: 6683)

CAGCTTCTGTTAAAGGTCACACAACTGGTCTCTCATTAAATAATGACCGGCTGTACAAGCTCACGTACTC

CACTGAAGTTCTTCTTGATCGGGGCAAAGGAAAACTGCAAGACAGCGTGGGCTACCGCATTTCCTCCAAC

TABLE 15-continued

Sequences of Exemplary Gene Targets

GTGGATGTGGCCTTACTATGGAGGAATCCTGATGGTGATGATGACCAGTTGATCCAAATAACGATGAAGG

ATGTAAATGTTGAAAATGTGAATCAGCAGAGAGGAGAGAAGAGCATCTTCAAAGGAAAAAGCCCATCTAA

AATAATGGGAAAGGAAAACTTGGAAGCTCTGCAAAGACCTACGCTCCTTCATCTAATCCATGGAAAGGTC

AAAGAGTTCTACTCATATCAAAATGAGGCAGTGGCCATAGAAAATATCAAGAGAGGTCTGGCTAGCCTAT

TTCAGACACAGTTAAGCTCTGGAACCACCAATGAGGTAGATATCTCTGGAAATTGTAAAGTGACCTACCA

GGCTCATCAAGACAAAGTGATCAAAATTAAGGCCTTGGATTCATGCAAAATAGCGAGGTCTGGATTTACG

ACCCCAAATCAGGTCTTGGGTGTCAGTTCAAAAGCTACATCTGTCACCACCTATAAGATAGAAGACAGCT

TTGTTATAGCTGTGCTTGCTGAAGAAACACACAATTTTGGACTGAATTTCCTACAAACCATTAAGGGGAA

AATAGTATCGAAGCAGAAATTAGAGCTGAAGACAACCGAAGCAGGCCCAAGATTGATGTCTGGAAAGCAG

GCTGCAGCCATAATCAAAGCAGTTGATTCAAAGTACACGGCCATTCCCATTGTGGGGCAGGTCTTCCAGA

GCCACTGTAAAGGATGTCCTTCTCTCGGAGCTCTGGCGGTCCACCAGGAAATACCTGCAGCCTGACAA

CCTTTCCAAGGCTGAGGCTGTCAGAAACTTCCTGGCCTTCATTCAGCACCTCAGGACTGCGAAGAAAGAA

GAGATCCTTCAAATACTAAAGATGGAAAATAAGGAAGTATTACCTCAGCTGGTGGATGCTGTCACCTCTG

CTCAGACCTCAGACTCATTAGAAGCCATTTTGGACTTTTTGGATTTCAAAAGTGACAGCAGCATTATCCT

CCAGGAGAGGTTTCTCTATGCCTGTGGATTTGCTTCTCATCCCAATGAAGAACTCCTGAGAGCCCTCATT

AGTAAGTTCAAAGGTTCTATTGGTAGCAGTGACATCAGAGAAACTGTTATGATCATCACTGGGACACTTG

TCAGAAAGTTGTGTCAGAATGAAGGCTGCAAACTCAAAGCAGTAGTGGAAGCTAAGAAGTTAATCCTGGG

AGGACTTGAAAAAGCAGAGAAAAAAGAGGACACCAGGATGTATCTGCTGGCTTTGAAGAATGCCCTGCTT

CCAGAAGGCATCCCAAGTCTTCTGAAGTATGCAGAAGCAGGAGAAGGGCCCATCAGCCACCTGGCTACCA

CTGCTCTCCAGAGATATGATCTCCCTTTCATAACTGATGAGGTGAAGAAGACCTTAAACAGAATATACCA

CCAAAACCGTAAAGTTCATGAAAAGACTGTGCGCACTGCTGCAGCTGCTATCATTTTAAATAACAATCCA

TCCTACATGGACGTCAAGAACATCCTGCTGTCTATTGGGGAGCTTCCCCAAGAAATGAATAAATACATGC

TCGCCATTGTTCAAGACATCCTACGTTTTGAAATGCCTGCAAGCAAAATTGTCCGTCGAGTTCTGAAGGA

AATGGTCGCTCACAATTATGACCGTTTCTCCAGGAGTGGATCTTCTTCTGCCTACACTGGCTACATAGAA

CGTAGTCCCCGTTCGGCATCTACTTACAGCCTAGACATTCTCTACTCGGGTTCTGGCATTCTAAGGAGAA

GTAACCTGAACATCTTTCAGTACATTGGGAAGGCTGGTCTTCACGGTAGCCAGGTGGTTATTGAAGCCCA

AGGACTGGAAGCCTTAATCGCAGCCACCCCTGACGAGGGGGAGGAGAACCTTGACTCCTATGCTGGTATG

TCAGCCATCCTCTTTGATGTTCAGCTCAGACCTGTCACCTTTTTCAACGGATACAGTGATTTGATGTCCA

AAATGCTGTCAGCATCTGGCGACCCTATCAGTGTGGTGAAAGGACTTATTCTGCTAATAGATCATTCTCA

GGAACTTCAGTTACAATCTGGACTAAAAGCCAATATAGAGGTCCAGGGTGGTCTAGCTATTGATATTTCA

GGTGCAATGGAGTTTAGCTTGTGGTATCGTGAGTCTAAAACCCGAGTGAAAAATAGGGTGACTGTGGTAA

TAACCACTGACATCACAGTGGACTCCTCTTTTGTGAAAGCTGGCCTGGAAACCAGTACAGAAACAGAAGC

AGGCTTGGAGTTTATCTCCACAGTGCAGTTTTCTCAGTACCCATTCTTAGTTTGCATGCAGATGGACAAG

GATGAAGCTCCATTCAGGCAATTTGAGAAAAAGTACGAAAGGCTGTCCACAGGCAGAGGTTATGTCTCTC

AGAAAAGAAAAGAAAGCGTATTAGCAGGATGTGAATTCCCGCTCCATCAAGAGAACTCAGAGATGTGCAA

AGTGGTGTTTGCCCCTCAGCCGGATAGTACTTCCAGCGGATGGTTTTGAAACTGACCTGTGATATTTTAC

TTGAATTTGTCTCCCCGAAAGGGACACAATGTGGCATGACTAAGTACTTGCTCTCTGAGAGCACAGCGTT

TACATATTTACCTGTATTTAAGATTTTTGTAAAAAGCTACAAAAAACTGCAGTTTGATCAAATTTGGGTA

TATGCAGTATGCTACCCACAGCGTCATTTTGAATCATCATGTGACGCTTTCAACAACGTTCTTAGTTTAC

TABLE 15-continued

Sequences of Exemplary Gene Targets

TTATACCTCTCTCAAATCTCATTTGGTACAGTCAGAATAGTTATTCTCTAAGAGGAAACTAGTGTTTGTT

AAAAACAAAATAAAAACAAAACCACACAAGGAGAACCCAATTTTGTTTCAACAATTTTTGATCAATGTA

TATGAAGCTCTTGATAGGACTTCCTTAAGCATGACGGGAAAACCAAACACGTTCCCTAATCAGGAAAAA

AAAAAAAAAAAAAAGTAAGACACAAACAAACCATTTTTTTCTCTTTTTTTGGAGTTGGGGGCCCAGGGAG

AAGGGACAAGGCTTTTAAAAGACTTGTTAGCCAACTTCAAGAATTAATATTTATGTCTCTGTTATTGTTA

GTTTTAAGCCTTAAGGTAGAAGGCACATAGAAATAACATC

>gi|1217638|emb|X91148.1|HSMTTP *H. sapiens* mRNA for
microsomal triglyceride transfer protein
TGCAGTTGAGGATTGCTGGTCAATATGATTCTTCTTGCTGTGCTTTTTCTCTGCTTCATTTCCTCATATT   (SEQ ID NO: 6684)

CAGCTTCTGTTAAAGGTCACACAACTGGTCTCTCATTAAATAATGACCGGCTGTACAAGCTCACGTACTC

CACTGAAGTTCTTCTTGATCGGGGCAAAGGAAAACTGCAAGACAGCGTGGGCTACCGCATTTCCTCCAAC

GTGGATGTGGCCTTACTATGGAGGAATCCTGATGGTGATGATGACCAGTTGATCCAAATAACGATGAAGG

ATGTAAATGTTGAAAATGTGAATCAGCAGAGAGGAGAGAAGAGCATCTTCAAAGGAAAAAGCCCATCTAA

AATAATGGGAAAGGAAAACTTGGAAGCTCTGCAAAGACCTACGCTCCTTCATCTAATCCATGGAAAGGTC

AAAGAGTTCTACTCATATCAAAATGAGGCAGTGGCCATAGAAAATATCAAGAGAGGTCTGGCTAGCCTAT

TTCAGACACAGTTAAGCTCTGGAACCACCAATGAGGTAGATATCTCTGGAAATTGTAAAGTGACCTACCA

GGCTCATCAAGACAAAGTGATCAAAATTAAGGCCTTGGATTCATGCAAAATAGCGAGGTCTGGATTTACG

ACCCCAAATCAGGTCTTGGGTGTCAGTTCAAAAGCTACATCTGTCACCACCTATAAGATAGAAGACAGCT

TTGTTATAGCTGTGCTTGCTGAAGAAACACACAATTTTGGACTGAATTTCCTACAAACCATTAAGGGGAA

AATAGTATCGAAGCAGAAATTAGAGCTGAAGACAACCGAAGCAGGCCCAAGATTGATGTCTGGAAAGCAG

GCTGCAGCCATAATCAAAGCAGTTGATTCAAAGTACACGGCCATTCCCATTGTGGGGCAGGTCTTCCAGA

GCCACTGTAAAGGATGTCCTTCTCTCTCGGAGCTCTGGCGGTCCACCAGGAAATACCTGCAGCCTGACAA

CCTTTCCAAGGCTGAGGCTGTCAGAAACTTCCTGGCCTTCATTCAGCACCTCAGGACTGCGAAGAAAGAA

GAGATCCTTCAAATACTAAAGATGGAAAATAAGGAAGTATTACCTCAGCTGGTGGATGCTGTCACCTCTG

CTCAGACCTCAGACTCATTAGAAGCCATTTTGGACTTTTTGGATTTCAAAAGTGACAGCAGCATTATCCT

CCAGGAGAGGTTTCTCTATGCCTGTGGATTTGCTTCTCATCCCAATGAAGAACTCCTGAGAGCCCTCATT

AGTAAGTTCAAAGGTTCTATTGGTAGCAGTGACATCAGAGAAACTGTTATGATCATCACTGGGACACTTG

TCAGAAAGTTGTGTCAGAATGAAGGCTGCAAACTCAAAGCAGTAGTGGAAGCTAAGAAGTTAATCCTGGG

AGGACTTGAAAAAGCAGAGAAAAAAGAGGACACCAGGATGTATCTGCTGGCTTTGAAGAATGCCCTGCTT

CCAGAAGGCATCCCAAGTCTTCTGAAGTATGCAGAAGCAGGAGAAGGGCCCATCAGCCACCTGGCTACCA

CTGCTCTCCAGAGATATGATGCTCCCTTTCATAACTGATGAGGTGAAGAAGACCTTAAACAGAATATACC

ACCAAAACCGTAAAGTTCATGAAAAGACTGTGCGCACTGCTGCAGCTGCTATCATTTTAAATAACAATCC

ATCCTACATGGACGTCAAGAACATCCTGCTGTCTATTGGGGAGCTTCCCCAAGAAATGAATAAATACATG

CTCGCCATTGTTCAAGACATCCTACGTTTTGAAATGCCTGCAAGCAAATTGTCCGTCGAGTTCTGAAGG

AAATGGTCGCTCACAATTATGACCGTTTCTCCAGGAGTGGATCTTCTTCTGCCTACACTGGCTACATAGA

ACGTAGTCCCCGTTCGGCATCTACTTACAGCCTAGACATTCTCTACTCGGGTTCTGGCATTCTAAGGAGA

AGTAACCTGAACATCTTTCAGTACATTGGGAAGGCTGGTCTTCACGGTAGCCAGGTGGTTATTGAAGCCC

AAGGACTGGAAGCCTTAATCGCAGCCACCCCTGACGAGGGGAGGAGAACCTTGACTCCTATGCTGGTAT

GTCAGCCATCCTCTTTGATGTTCAGCTCAGACCTGTCACCTTTTTCAACGGATACAGTGATTTGATGTCC

AAAATGCTGTCAGCATCTGGCGACCCTATCAGTGTGGTGAAAGGACTTATTCTGCTAATAGATCATTCTC

TABLE 15-continued

Sequences of Exemplary Gene Targets

AGGAACTTCAGTTACAATCTGGACTAAAAGCCAATATAGAGGTCCAGGGTGGTCTAGCTATTGATATTTC

AGGTGCAATGGAGTTTAGCTTGTGGTATCGTGAGTCTAAAACCCGAGTGAAAAATAGGGTGACTGTGGTA

ATAACCACTGACATCACAGTGGACTCCTCTTTTGTGAAAGCTGGCCTGGAAACCAGTACAGAAACAGAAG

CAGGCTTGGAGTTTATCTCCACAGTGCAGTTTTCTCAGTACCCATTCTTAGTTTGCATGCAGATGGACAA

GGATGAAGCTCCATTCAGGCAATTTGAGAAAAAGTACGAAAGGCTGTCCACAGGCAGAGGTTATGTCTCT

CAGAAAAGAAAAGAAAGCGTATTAGCAGGATGTGAATTCCCGCTCCATCAAGAGAACTCAGAGATGTGCA

AAGTGGTGTTTGCCCCTCAGCCGGATAGTACTTCCAGCGGATGGTTTTGAAACTGACCTGTGATATTTTA

CTTGAATTTGTCTCCCCGAAAGGGACACAATGTGGCATGACTAAGTACTTGCTCTCTGAGAGCACAGCGT

TTACATATTTACCTGTATTTAAGATTTTTGTAAAAAGCTACAAAAAACTGCAGTTTGATCAAATTTGGGT

ATATGCAGTATGCTACCCACAGCGTCATTTTGAATCATCATGTGACGCTTTCAACAACGTTCTTAGTTTA

CTTATACCTCTCTCAAATCTCATTTGGTACAGTCAGAATAGTTATTCTCTAAGAGGAAACTAGTGTTTGT

TAAAAACAAAAATAAAAACAAAACCACACAAGGAGAACCCAATTTTGTTTCAACAATTTTTGATCAATGT

ATATGAAGCTCTTGATAGGACTTCCTTAAGCATGACGGGAAAACCAAACACGTTCCCTAATCAGGAAAAA

AAAAAAAAAAGAAAAAGTAAGACACAAACAAACCATTTTTTTCTCTTTTTTTGGAGTTGGGGGCCCAGGG

AGAAGGGACAAGGCTTTTAAAAGACTTGTTAGCCAACTTCAAGAATTAATATTTATGTCTCTGTTATTGT

TAGTTTTAAGCCTTAAGGTAGAAGGCACATAGAAATAACATCTCATCTTTCTGCTGACCATTTTAGTGAG

GTTGTTCCAAAGAGCATTCAGGTCTCTACCTCCAGCCCTGCAAAAATATTGGACCTAGCACAGAGGAATC

AGGAAAATTAATTTCAGAAACTCCATTTGATTTTTCTTTTGCTGTGTCTTTTTTGAGACTGTAATATGGT

ACACTGTCCTCTAAGGACATCCTCATTTTATCTCACCTTTTTGGGGGTGAGAGCTCTAGTTCATTTAACT

GTACTCTGCACAATAGCTAGGATGACTAAGAGAACATTGCTTCAAGAAACTGGTGGATTTGGATTTCCAA

AATATGAAATAAGGAGAAAAATGTTTTTATTTGTATGAATTAAAAGATCCATGTTGAACATTTGCAAATA

TTTATTAATAAACAGATGTGGTGATAAACCCAAAACAAATGACAGGTGCTTATTTTCCACTAAACACAGA

CACATGAAATGAAAGTTTAGCTAGCCCACTATTTGTTGTAAATTGAAAACGAAGTGTGATAAAATAAATA

TGTAGAAATCAAAAAAAAAAAAAAAAAAAA

```
>gi|21361125|ref|NM_001467.2| Homo sapiens
glucose-6-phosphatase, transport (glucose-6-phosphate) protein 1 (G6PT1),
 mRNA
```
GGCACGAGGGGCCACCGAGGCGCTGTCCCTGACCACCAGCACGAGACCCCTTTCTATCGCGCCAGTCCTG    (SEQ ID NO: 6685)

TGGTCTCCGCACCTCTCCAGCTCCTGCACCCCCGGCCCCGTGGTTCCCAGCCGCACAGTAGCGTGTCCT

GGGTAGCGTGAGGACCCACGGGGCTGAGCAGGTGCCACGAGCCCGCCGCCTCTTCGCCGCCCGCCGCCTC

TCCTCCTCTCCCGCCCGCCGCCTGGCCCTCCCCTACCAGGCTGAGCCTCTGGCTGCCAGAAGCGCGGGGC

CTCCGGGAGAATACGTGCGGTCGCCCGCTCCGCGTGCGCCTACGCCTTCTGCTCCAGTTGCTTTCCCAAT

TGAGCGGAAAAGCCGGGGCATGTTGCCGGGGCCCTGGGCGGGACGGTTGTGCCCTGCAGCCCGAAGCCCG

CCGGGGCACCTTCCCGCCCACGAGCTGCCCAGTCCCTCTGCTTGCGGCCCCTGCCAACGTCCCACAGGAC

ACTGGGTCCCCTTGGAGCCTCCCCAGGCTTAATGATTGTCCAGAAGGCGGCTATAAAGGGAGCCTGGGAG

GCTGGGTGGAGGAGGGAGCAGAAAAAACCCAACTCAGCAGATCTGGGAACTGTGAGAGCGGCAAGCAGGA

ACTGTGGTCAGAGGCTGTGCGTCTTGGCTGGTAGGGCCTGCTCTTTTCTACCATGGCAGCCCAGGGCTAT

GGCTATTATCGCACTGTGATCTTCTCAGCCATGTTTGGGGGCTACAGCCTGTATTACTTCAATCGCAAGA

CCTTCTCCTTTGTCATGCCATCATTGGTGGAAGAGATCCCTTTGGACAAGGATGATTTGGGGTTCATCAC

TABLE 15-continued

Sequences of Exemplary Gene Targets

CAGCAGCCAGTCGGCAGCTTATGCTATCAGCAAGTTTGTCAGTGGGGTGCTGTCTGACCAGATGAGTGCT

CGCTGGCTCTTCTCTTCTGGGCTGCTCCTGGTTGGCCTGGTCAACATATTCTTTGCCTGGAGCTCCACAG

TACCTGTCTTTGCTGCCCTCTGGTTCCTTAATGGCCTGGCCCAGGGGCTGGGCTGGCCCCCATGTGGGAA

GGTCCTGCGGAAGTGGTTTGAGCCATCTCAGTTTGGCACTTGGTGGGCCATCCTGTCAACCAGCATGAAC

CTGGCTGGAGGGCTGGGCCCTATCCTGGCAACCATCCTTGCCCAGAGCTACAGCTGGCGCAGCACGCTGG

CCCTATCTGGGGCACTGTGTGTGGTTGTCTCCTTCCTCTGTCTCCTGCTCATCCACAATGAACCTGCTGA

TGTTGGACTCCGCAACCTGGACCCCATGCCCTCTGAGGGCAAGAAGGGCTCCTTGAAGGAGGAGAGCACC

CTGCAGGAGCTGCTGCTGTCCCCTTACCTGTGGGTGCTCTCCACTGGTTACCTTGTGGTGTTTGGAGTAA

AGACCTGCTGTACTGACTGGGGCCAGTTCTTCCTTATCCAGGAGAAAGGACAGTCAGCCCTTGTAGGTAG

CTCCTACATGAGTGCCCTGGAAGTTGGGGGCCTTGTAGGCAGCATCGCAGCTGGCTACCTGTCAGACCGG

GCCATGGCAAAGGCGGGACTGTCCAACTACGGGAACCCTCGCCATGGCCTGTTGCTGTTCATGATGGCTG

GCATGACAGTGTCCATGTACCTCTTCCGGGTAACAGTGACCAGTGACTCCCCCAAGCTCTGGATCCTGGT

ATTGGGAGCTGTATTTGGTTTCTCCTCGTATGGCCCCATTGCCCTGTTTGGAGTCATAGCCAACGAGAGT

GCCCCTCCCAACTTGTGTGGCACCTCCCACGCCATTGTGGGACTCATGGCCAATGTGGGCGGCTTTCTGG

CTGGGCTGCCCTTCAGCACCATTGCCAAGCACTACAGTTGGAGCACAGCCTTCTGGGTGGCTGAAGTGAT

TTGTGCGGCCAGCACGGCTGCCTTCTTCCTCCTACGAAACATCCGCACCAAGATGGGCCGAGTGTCCAAG

AAGGCTGAGTGAAGAGAGTCCAGGTTCCGGAGCACCATCCCACGGTGGCCTTCCCCCTGCACGCTCTGCG

GGGAGAAAAGGAGGGGCCTGCCTGGCTAGCCCTGAACCTTTCACTTTCCATTTCTGCGCCTTTTCTGTCA

CCCGGGTGGCGCTGGAAGTTATCAGTGGCTAGTGAGGTCCCAGCTCCCTGATCCTATGCTCTATTTAAAA

GATAACCTTTGGCCTTAGACTCCGTTAGCTCCTATTTCCTGCCTTCAGACAAACAGGAAACTTCTGCAGT

CAGGAAGGCTCCTGTACCCTTCTTCTTTTCCTAGGCCCTGTCCTGCCCGCATCCTACCCCATCCCCACCT

GAAGTGAGGCTATCCCTGCAGCTGCAGGGCACTAATGACCCTTGACTTCTGCTGGGTCCTAAGTCCTCTC

AGCAGTGGGTGACTGCTGTTGCCAATACCTCAGACTCCAGGGAAAGAGAGGAGGCCATCATTCTCACTGT

ACCACTAGGCGCAGTTGGATATAGGTGGGAAGAAAAGGTGACTTGTTATAGAAGATTAAAACTAGATTTG

ATACTGAAAAAAAAAAAAAAAAAAAAAAAAAAAAAAAAAA gi|4503130|ref|NM_001904.1| *Homo sapiens* catenin
(cadherin-associated protein), beta 1, 88 kDa (CTNNB1), mRNA AAGCCTCTCGGTCTGTGGCAGCAGCGTTGGCCCGGCCCCGGGAGCGGAGAGCGAGGGGAGGCGGAGACGG    (SEQ ID NO: 6686)

AGGAAGGTCTGAGGAGCAGCTTCAGTCCCCGCCGAGCCGCCACCGCAGGTCGAGGACGGTCGGACTCCCG

CGGCGGGAGGAGCCTGTTCCCCTGAGGGTATTTGAAGTATACCATACAACTGTTTTGAAAATCCAGCGTG

GACAATGGCTACTCAAGCTGATTTGATGGAGTTGGACATGGCCATGGAACCAGACAGAAAAGCGGCTGTT

AGTCACTGGCAGCAACAGTCTTACCTGGACTCTGGAATCCATTCTGGTGCCACTACCACAGCTCCTTCTC

TGAGTGGTAAAGGCAATCCTGAGGAAGAGGATGTGGATACCTCCCAAGTCCTGTATGAGTGGGAACAGGG

ATTTTCTCAGTCCTTCACTCAAGAACAAGTAGCTGATATTGATGGACAGTATGCAATGACTCGAGCTCAG

AGGGTACGAGCTGCTATGTTCCCTGAGACATTAGATGAGGGCATGCAGATCCCATCTACACAGTTTGATG

CTGGTCATCCCACTAATGTCCAGCGTTTGGCTGAACCATCACAGATGCTGAAACATGCAGTTGTAAACTT

GATTAACTATCAAGATGATGCAGAACTTGCCACACGTGCAATCCCTGAACTGACAAAACTGCTAAATGAC

GAGGACCAGGTGGTGGTTAATAAGGCTGCAGTTATGGTCCATCAGCTTTCTAAAAAGGAAGCTTCCAGAC

ACGCTATCATGCGTTCTCCTCAGATGGTGTCTGCTATTGTACGTACCATGCAGAATACAAATGATGTAGA

AACAGCTCGTTGTACCGCTGGGACCTTGCATAACCTTTCCCATCATCGTGAGGGCTTACTGGCCATCTTT

TABLE 15-continued

Sequences of Exemplary Gene Targets

AAGTCTGGAGGCATTCGTGCCCTGGTGAAAATGCTTGGTTCACCAGTGGATTCTGTGTTGTTTTATGCCA

TTACAACTCTCCACAACCTTTTATTACATCAAGAAGGAGCTAAAATGGCAGTGCGTTTAGCTCGTGGGCT

GCAGAAAATGGTTGCCTTGCTCAACAAAACAAATGTTAAATTCTTGGCTATTACGACAGACTGCCTTCAA

ATTTTAGCTTATGGCAACCAAGAAAGCAAGCTCATCATACTGGCTAGTGGTGGACCCCAAGCTTTAGTAA

ATATAATGAGGACCTATACTTACGAAAAACTACTGTGGACCACAAGCAGAGTGCTGAAGGTGCTATCTGT

CTGCTCTAGTAATAAGCCGGCTATTGTAGAAGCTGGTGGAATGCAAGCTTTAGGACTTCACCTGACAGAT

CCAAGTCAACGTCTTGTTCAGAACTGTCTTTGGACTCTCAGGAATCTTTCAGATGCTGCAACTAAACAGG

AAGGGATGGAAGGTCTCCTTGGGACTCTTGTTCAGCTTCTGGGTTCAGATGATATAAATGTGGTCACCTG

TGCAGCTGGAATTCTTTCTAACCTCACTTGCAATAATTATAAGAACAAGATGATGGTCTGCCAAGTGGGT

GGTATAGAGGCTCTTGTGCGTACTGTCGTTCGGGCTGGTGACAGGGAAGACATCACTGAGCCTGCCATCT

GTGCTCTTCGTCATCTGACCAGCCGACACCAAGAAGCAGAGATGGCCCAGAATGCAGTTCGCCTTCACTA

TGGACTACCAGTTGTGGTTAAGCTCTTACACCCACCATCCCACTGGCCTCTGATAAAGGCTACTGTTGGA

TTGATTCGAAATCTTGCCCTTTGTCCCGCAAATCATGCACCTTTGCGTGAGCAGGGTGCCATTCCACGAC

TAGTTCAGTTGCTTGTTCGTGCACATCAGGATACCCAGCGCCGTACGTCCATGGGTGGGACACAGCAGCA

ATTTGTGGAGGGGTCCGCATGGAAGAAATAGTTGAAGGTTGTACCGGAGCCCTTCACATCCTAGCTCGG

GATGTTCACAACCGAATTGTTATCAGAGGACTAAATACCATTCCATTGTTTGTGCAGCTGCTTTATTCTC

CCATTGAAAACATCCAAAGAGTAGCTGCAGGGGTCCTCTGTGAACTTGCTCAGGACAAGGAAGCTGCAGA

AGCTATTGAAGCTGAGGGAGCCAGAGCTCCTCTGACAGAGTTACTTCACTCTAGGAATGAAGGTGTGGCG

ACATATGCAGCTGCTGTTTTGTTCCGAATGTCTGAGGACAAGCCACAAGATTACAAGAAACGGCTTTCAG

TTGAGCTGACCAGCTCTCTCTTCAGAACAGAGCCAATGGCTTGCAATGAGACTGCTGATCTTGGACTTGA

TATTGGTGCCCAGGGAGAACCCCTTGGATATCGCCAGGATGATCCTAGCTATCGTTCTTTTCACTCTGGT

GGATATGGGCAGGATGCCTTGGGTATGGACCCCATGATGGAACATGAGATGGGTGGCCACCACCCTGGTG

CTGACTATCCAGTTGATGGGCTGCCAGATCTGGGGCATGCCCAGGACCTCATGGATGGGCTGCCTCCAGG

TGACAGCAATCAGCTGGCCTGGTTTGATACTGACCTGTAAATCATCCTTTAGCTGTATTGTCTGAACTTG

CATTGTGATTGGCCTGTAGAGTTGCTGAGAGGGCTCGAGGGGTGGGCTGGTATCTCAGAAAGTGCCTGAC

ACACTAACCAAGCTGAGTTTCCTATGGGAACAATTGAAGTAAACTTTTTGTTCTGGTCCTTTTTGGTCGA

GGAGTAACAATACAAATGGATTTTGGGAGTGACTCAAGAAGTGAAGAATGCACAAGAATGGATCACAAGA

TGGAATTTAGCAAACCCTAGCCTTGCTTGTTAAAATTTTTTTTTTTTTTTTAAGAATATCTGTAATG

GTACTGACTTTGCTTGCTTTGAAGTAGCTCTTTTTTTTTTTTTTTTTTTTTTTTTGCAGTAACTGTTT

TTTAAGTCTCTCGTAGTGTTAAGTTATAGTGAATACTGCTACAGCAATTTCTAATTTTTAAGAATTGAGT

AATGGTGTAGAACACTAATTAATTCATAATCACTCTAATTAATTGTAATCTGAATAAAGTGTAACAATTG

TGTAGCCTTTTTGTATAAAATAGACAAATAGAAAATGGTCCAATTAGTTTCCTTTTTAATATGCTTAAAA

TAAGCAGGTGGATCTATTTCATGTTTTTGATCAAAAACTATTTGGGATATGTATGGGTAGGGTAAATCAG

TAAGAGGTGTTATTTGGAACCTTGTTTTGGACAGTTTACCAGTTGCCTTTTATCCCAAAGTTGTTGTAAC

CTGCTGTGATACGATGCTTCAAGAGAAAATGCGGTTATAAAAAATGGTTCAGAATTAAACTTTTAATTCATT gi|18104977|ref|NM_002827.2| Homo sapiens protein
tyrosine phosphatase, non-receptor type 1 (PTPN1), mRNA
GTGATGCGTAGTTCCGGCTGCCGGTTGACATGAAGAAGCAGCAGCGGCTAGGGCGGCGGTAGCTGCAGGG    (SEQ ID NO: 6687)

GTCGGGGATTGCAGCGGGCCTCGGGGCTAAGAGCGCGACGCGGCCTAGAGCGGCAGACGGCGCAGTGGGC

CGAGAAGGAGGCGCAGCAGCCGCCCTGGCCCGTCATGGAGATGGAAAAGGAGTTCGAGCAGATCGACAAG

TABLE 15-continued

Sequences of Exemplary Gene Targets

```
TCCGGGAGCTGGGCGGCCATTTACCAGGATATCCGACATGAAGCCAGTGACTTCCCATGTAGAGTGGCCA

AGCTTCCTAAGAACAAAAACCGAAATAGGTACAGAGACGTCAGTCCCTTTGACCATAGTCGGATTAAACT

ACATCAAGAAGATAATGACTATATCAACGCTAGTTTGATAAAAATGGAAGAAGCCCAAAGGAGTTACATT

CTTACCCAGGGCCCTTTGCCTAACACATGCGGTCACTTTTGGGAGATGGTGTGGGAGCAGAAAAGCAGGG

GTGTCGTCATGCTCAACAGAGTGATGGAGAAAGGTTCGTTAAAATGCGCACAATACTGGCCACAAAAGA

AGAAAAAGAGATGATCTTTGAAGACACAAATTTGAAATTAACATTGATCTCTGAAGATATCAAGTCATAT

TATACAGTGCGACAGCTAGAATTGGAAAACCTTACAACCCAAGAAACTCGAGAGATCTTACATTTCCACT

ATACCACATGGCCTGACTTTGGAGTCCCTGAATCACCAGCCTCATTCTTGAACTTTCTTTTCAAAGTCCG

AGAGTCAGGGTCACTCAGCCCGGAGCACGGGCCCGTTGTGGTGCACTGCAGTGCAGGCATCGGCAGGTCT

GGAACCTTCTGTCTGGCTGATACCTGCCTCTTGCTGATGGACAAGAGGAAAGACCCTTCTTCCGTTGATA

TCAAGAAAGTGCTGTTAGAAATGAGGAAGTTTCGGATGGGGCTGATCCAGACAGCCGACCAGCTGCGCTT

CTCCTACCTGGCTGTGATCGAAGGTGCCAAATTCATCATGGGGGACTCTTCCGTGCAGGATCAGTGGAAG

GAGCTTTCCCACGAGGACCTGGAGCCCCACCCGAGCATATCCCCCCACCTCCCCGGCCACCCAAACGAA

TCCTGGAGCCACACAATGGGAAATGCAGGGAGTTCTTCCCAAATCACCAGTGGGTGAAGGAAGAGACCCA

GGAGGATAAAGACTGCCCCATCAAGGAAGAAAAAGGAAGCCCCTTAAATGCCGCACCCTACGGCATCGAA

AGCATGAGTCAAGACACTGAAGTTAGAAGTCGGGTCGTGGGGGGAAGTCTTCGAGGTGCCCAGGCTGCCT

CCCCAGCCAAAGGGGAGCCGTCACTGCCCGAGAAGGACGAGGACCATGCACTGAGTTACTGGAAGCCCTT

CCTGGTCAACATGTGCGTGGCTACGGTCCTCACGGCCGGCGCTTACCTCTGCTACAGGTTCCTGTTCAAC

AGCAACACATAGCCTGACCCTCCTCCACTCCACCTCCACCCACTGTCCGCCTCTGCCCGCAGAGCCCACG

CCCGACTAGCAGGCATGCCGCGGTAGGTAAGGGCCGCCGGACCGCGTAGAGAGCCGGGCCCCGGACGGAC

GTTGGTTCTGCACTAAAACCCATCTTCCCCGGATGTGTGTCTCACCCCTCATCCTTTTACTTTTGCCCC

TTCCACTTTGAGTACCAAATCCACAAGCCATTTTTTGAGGAGAGTGAAAGAGAGTACCATGCTGGCGGCG

CAGAGGGAAGGGGCCTACACCCGTCTTGGGGCTCGCCCCACCCAGGGCTCCCTCCTGGAGCATCCCAGGC

GGGCGGCACGCCAACAGCCCCCCCCTTGAATCTGCAGGGAGCAACTCTCCACTCCATATTTATTTAAACA

ATTTTTTCCCCAAAGGCATCCATAGTGCACTAGCATTTTCTTGAACCAATAATGTATTAAAATTTTTTGA

TGTCAGCCTTGCATCAAGGGCTTTATCAAAAAGTACAATAATAAATCCTCAGGTAGTACTGGGAATGGAA

GGCTTTGCCATGGGCCTGCTGCGTCAGACCAGTACTGGGAAGGAGGACGGTTGTAAGCAGTTGTTATTTA

GTGATATTGTGGGTAACGTGAGAAGATAGAACAATGCTATAATATATAATGAACACGTGGGTATTTAATA

AGAAACATGATGTGAGATTACTTTGTCCCGCTTATTCTCCTCCCTGTTATCTGCTAGATCTAGTTCTCAA

TCACTGCTCCCCGTGTGTATTAGAATGCATGTAAGGTCTTCTTGTGTCCTGATGAAAAATATGTGCTTG

AAATGAGAAACTTTGATCTCTGCTTACTAATGTGCCCCATGTCCAAGTCCAACCTGCCTGTGCATGACCT

GATCATTACATGGCTGTGGTTCCTAAGCCTGTTGCTGAAGTCATTGTCGCTCAGCAATAGGGTGCAGTTT

TCCAGGAATAGGCATTTGCCTAATTCCTGGCATGACACTCTAGTGACTTCCTGGTGAGGCCCAGCCTGTC

CTGGTACAGCAGGGTCTTGCTGTAACTCAGACATTCCAAGGGTATGGGAAGCCATATTCACACCTCACGC

TCTGGACATGATTTAGGGAAGCAGGGACACCCCCGCCCCCCACCTTTGGGATCAGCCTCCGCCATTCCA

AGTCAACACTCTTCTTGAGCAGACCGTGATTTGGAAGAGAGGCACCTGCTGGAAACCACACTTCTTGAAA

CAGCCTGGGTGACGGTCCTTTAGGCAGCCTGCCGCCGTCTCTGTCCCGGTTCACCTTGCCGAGAGAGGCG

CGTCTGCCCCACCCTCAAACCCTGTGGGGCCTGATGGTGCTCACGACTCTTCCTGCAAAGGGAACTGAAG

ACCTCCACATTAAGTGGCTTTTTAACATGAAAAACACGGCAGCTGTAGCTCCCGAGCTACTCTCTTGCCA
```

TABLE 15-continued

Sequences of Exemplary Gene Targets

GCATTTTCACATTTTGCCTTTCTCGTGGTAGAAGCCAGTACAGAGAAATTCTGTGGTGGGAACATTCGAG

GTGTCACCCTGCAGAGCTATGGTGAGGTGTGGATAAGGCTTAGGTGCCAGGCTGTAAGCATTCTGAGCTG

GGCTTGTTGTTTTTAAGTCCTGTATATGTATGTAGTAGTTTGGGTGTGTATATATAGTAGCATTTCAAAA

TGGACGTACTGGTTTAACCTCCTATCCTTGGAGAGCAGCTGGCTCTCCACCTTGTTACACATTATGTTAG

AGAGGTAGCGAGCTGCTCTGCTATATGCCTTAAGCCAATATTTACTCATCAGGTCATTATTTTTTACAAT

GGCCATGGAATAAACCATTTTTACAAAA gi|12831192|gb|AF333324.1| Hepatitis C virus type 1b
polyprotein mRNA, complete cds
GCCAGCCCCGATTGGGGGCGACACTCCACCATAGATCACTCCCCTGTGAGGAACTACTGTCTTCACGCA  (SEQ ID NO: 6688)

GAAAGCGTCTAGCCATGGCGTTAGTATGAGTGTCGTGCAGCCTCCAGGACCCCCCTCCCGGGAGAGCCA

TAGTGGTCTGCGGAACCGGTGAGTACACCGGAATTGCCAGGACGACCGGGTCCTTTCTTGGATCAACCCG

CTCAATGCCTGGAGATTTGGGCGTGCCCCCGCGAGACTGCTAGCCGAGTAGTGTTGGGTCGCGAAAGGCC

TTGTGGTACTGCCTGATAGGGTGCTTGCGAGTGCCCCGGGAGGTCTCGTAGACCGTGCATCATGAGCACA

AATCCTAAACCTCAAAGAAAAACCAAACGTAACACCAACCGCCGCCCACAGGACGTTAAGTTCCCGGGCG

GTGGTCAGATCGTTGGTGGAGTTTACCTGTTGCCGCGCAGGGGCCCCAGGTTGGGTGTGCGCGCGACTAG

GAAGACTTCCGAGCGGTCGCAACCTCGTGGAAGGCGACAACCTATCCCCAAGGCTCGCCGGCCCGAGGGT

AGGACCTGGGCTCAGCCCGGGTACCCTTGGCCCCTCTATGGCAACGAGGGTATGGGGTGGGCAGGATGGC

TCCTGTCACCCCGTGGCTCTCGGCCTAGTTGGGGCCCCACAGACCCCGGCGTAGGTCGCGTAATTTGGG

TAAGGTCATCGATACCCTTACATGCGGCTTCGCCGACCTCATGGGGTACATTCCGCTTGTCGGCGCCCCC

CTAGGAGGCGCTGCCAGGGCCCTGGCGCATGGCGTCCGGGTTCTGGAGGACGGCGTGAACTATGCAACAG

GGAATCTGCCCGGTTGCTCTTTCTCTATCTTCCTCTTAGCTTTGCTGTCTTGTTTGACCATCCCAGCTTC

CGCTTACGAGGTGCGCAACGTGTCCGGGATATACCATGTCACGAACGACTGCTCCAACTCAAGTATTGTG

TATGAGGCAGCGGACATGATCATGCACACCCCCGGGTGCGTGCCCTGCGTCCGGGAGAGTAATTTCTCCC

GTTGCTGGGTAGCGCTCACTCCCACGCTCGCGGCCAGGAACAGCAGCATCCCCACCACGACAATACGACG

CCACGTCGATTTGCTCGTTGGGCGGCTGCTCTCTGTTCCGCTATGTACGTTGGGGATCTCTGCGGATCC

GTTTTTCTCGTCTCCCAGCTGTTCACCTTCTCACCTCGCCGGTATGAGACGGTACAAGATTGCAATTGCT

CAATCTATCCCGGCCACGTATCAGGTCACCGCATGGCTTGGGATATGATGATGAACTGGTCACCTACAAC

GGCCCTAGTGGTATCGCAGCTACTCCGGATCCCACAAGCCGTCGTGGACATGGTGGCGGGGGCCCACTGG

GGTGTCCTAGCGGGCCTTGCCTACTATTCCATGGTGGGGAACTGGGCTAAGGTCTTGATTGTGATGCTAC

TCTTTGCTGGCGTTGACGGGCACACCCACGTGACAGGGGGAAGGGTAGCCTCCAGCACCCAGAGCCTCGT

GTCCTGGCTCTCACAAGGGCCATCTCAGAAAATCCAACTCGTGAACACCAACGGCAGCTGGCACATCAAC

AGGACCGCTCTGAATTGCAATGACTCCCTCCAAACTGGGTTCATTGCTGCGCTGTTCTACGCACACAGGT

TCAACGCGTCCGGATGTCCAGAGCGCATGGCCAGCTGCCGCCCCATCGACAAGTTCGCTCAGGGGTGGGG

TCCCATCACTCACGTTGTGCCTAACATCTCGGACCAGAGGCCTTATTGCTGGCACTATGCACCCCAACCG

TGCGGTATTGTACCCGCGTCGCAGGTGTGTGGCCCAGTGTATTGCTTCACCCCGAGTCCTGTTGTGGTGG

GGACGACCGACCGTTCCGGAGTCCCCACGTATAGCTGGGGGGAGAATGAGACAGACGTGCTGCTACTCAA

CAACACGCGGCCGCCGCAAGGCAACTGGTTCGGCTGTACATGGATGAATAGCACCGGGTTCACCAAGACG

TGCGGGGGCCCCCCGTGTAACATCGGGGGGGTTGGCAACAACACCTTGATTTGCCCCACGGATTGCTTCC

GAAAGCACCCCGAGGCCACTTACACCAAATGCGGCTCGGGTCCTTGGTTGACACCTAGGTGTCTAGTTGA

CTACCCATACAGACTTTGGCACTACCCCTGCACTATCAATTTTACCATCTTCAAGGTCAGGATGTACGTG

TABLE 15-continued

Sequences of Exemplary Gene Targets

```
GGGGGCGTGGAGCACAGGCTCAACGCCGCGTGCAATTGGACCCGAGGAGAGCGCTGTGACCTGGAGGACA
GGGATAGATCAGAGCTTAGCCCGCTGCTATTGTCTACAACGGAGTGGCAGGTACTGCCCTGTTCCTTTAC
CACCCTACCGGCTCTGTCCACTGGATTGATCCACCTCCATCAGAATATCGTGGACGTGCAATACCTGTAC
GGTGTAGGGTCAGTGGTTGTCTCCGTCGTAATCAAATGGGAGTATGTTCTGCTGCTCTTCCTTCTCCTGG
CGGACGCGCGCGTCTGTGCCTGCTTGTGGATGATGCTGCTGATAGCCCAGGCTGAGGCCACCTTAGAGAA
CCTGGTGGTCCTCAATGCGGCGTCTGTGGCCGGAGCGCATGGCCTTCTCTCCTTCCTCGTGTTCTTCTGC
GCCGCCTGGTACATCAAAGGCAGGCTGGTCCCTGGGGCGGCATATGCTCTCTATGGCGTATGGCCGTTGC
TCCTGCTCTTGCTGGCTTTACCACCACGAGCTTATGCCATGGACCGAGAGATGGCTGCATCGTGCGGAGG
CGCGGTTTTTGTAGGTCTGGTACTCTTGACCTTGTCACCATACTATAAGGTGTTCCTCGCTAGGCTCATA
TGGTGGTTACAATATTTTATCACCAGGGCCGAGGCGCACTTGCAAGTGTGGGTCCCCCCTCTTAATGTTC
GGGGAGGCCGCGATGCCATCATCCTCCTTACATGCGCGGTCCATCCAGAGCTAATCTTTGACATCACCAA
ACTCCTGCTCGCCATACTCGGTCCGCTCATGGTGCTCCAAGCTGGCATAACCAGAGTGCCGTACTTCGTG
CGCGCTCAAGGGCTCATTCATGCATGCATGTTAGTGCGGAAGGTCGCTGGGGGTCATTATGTCCAAATGG
CCTTCATGAAGCTGGGCGCGCTGACAGGCACGTACATTTACAACCATCTTACCCCGCTACGGGATTGGGC
CCACGCGGGCCTACGAGACCTTGCGGTGGCAGTGGAGCCCGTCGTCTTCTCCGACATGGAGACCAAGATC
ATCACCTGGGGAGCAGACACCGCGGCGTGTGGGGACATCATCTTGGGTCTGCCCGTCTCCGCCCGAAGGG
GAAAGGAGATACTCCTGGGCCCGGCCGATAGTCTTGAAGGGCGGGGGTGGCGACTCCTCGCGCCCATCAC
GGCCTACTCCCAACAGACGCGGGGCCTACTTGGTTGCATCATCACTAGCCTTACAGGCCGGGACAAGAAC
CAGGTCGAGGGAGAGGTTCAGGTGGTTTCCACCGCAACACAATCCTTCCTGGCGACCTGCGTCAACGGCG
TGTGTTGGACCGTTTACCATGGTGCTGGCTCAAAGACCTTAGCCGGCCCAAAGGGGCCAATCACCCAGAT
GTACACTAATGTGGACCAGGACCTCGTCGGCTGGCAGGCGCCCCCGGGGCGCGTTCCTTGACACCATGC
ACCTGTGGCAGCTCAGACCTTTACTTGGTCACGAGACATGCTGACGTCATTCCGGTGCGCCGGCGGGGCG
ACAGTAGGGGAGCCTGCTCTCCCCCAGGCCTGTCTCCTACTTGAAGGGCTCTTCGGGTGGTCCACTGCT
CTGCCCTTCGGGGCACGCTGTGGGCATCTTCCGGGCTGCCGTATGCACCCGGGGGGTTGCGAAGGCGGTG
GACTTTGTGCCCGTAGAGTCCATGGAAACTACTATGCGGTCTCCGGTCTTCACGGACAACTCATCCCCCC
CGGCCGTACCGCAGTCATTTCAAGTGGCCCACCTACACGCTCCCACTGGCAGCGGCAAGAGTACTAAAGT
GCCGGCTGCATATGCAGCCCAAGGGTACAAGGTGCTCGTCCTCAATCCGTCCGTTGCCGCTACCTTAGGG
TTTGGGGCGTATATGTCTAAGGCACACGGTATTGACCCCAACATCAGAACTGGGGTAAGGACCATTACCA
CAGGCGCCCCCGTCACATACTCTACCTATGGCAAGTTTCTTGCCGATGGTGGTTGCTCTGGGGGCGCTTA
TGACATCATAATATGTGATGAGTGCCATTCAACTGACTCGACTACAATCTTGGGCATCGGCACAGTCCTG
GACCAAGCGGAGACGGCTGGAGCGCGGCTTGTCGTGCTCGCCACCGCTACGCCTCCGGGATCGGTCACCG
TGCCACACCCAAACATCGAGGAGGTGGCCCTGTCTAATACTGGAGAGATCCCCTTCTATGGCAAAGCCAT
CCCCATTGAAGCCATCAGGGGGGAAGGCATCTCATTTTCTGTCATTCCAAGAAGAAGTGCGACGAGCTC
GCCGCAAAGCTGTCAGGCCTCGGAATCAACGCTGTGGCGTATTACCGGGGGCTCGATGTGTCCGTCATAC
CAACTATCGGAGACGTCGTTGTCGTGGCAACAGACGCTCTGATGACGGGCTATACGGGCGACTTTGACTC
AGTGATCGACTGTAACACATGTGTCACCCAGACAGTCGACTTCAGCTTGGATCCCACCTTCACCATTGAG
ACGACGACCGTGCCTCAAGACGCAGTGTCGCGCTCGCAGCGGCGGGGTAGGACTGGCAGGGGTAGGAGAG
GCATCTACAGGTTTGTGACTCCGGGAGAACGGCCCTCGGGCATGTTCGATTCCTCGGTCCTGTGTGAGTG
CTATGACGCGGGCTGTGCTTGGTACGAGCTCACCCCCGCCCAGACCTCGGTTAGGTTGCGGGCCTACCTG
```

TABLE 15-continued

Sequences of Exemplary Gene Targets

```
AACACACCAGGGTTGCCCGTTTGCCAGGACCACCTGGAGTTCTGGGAGAGTGTCTTCACAGGCCTCACCC
ACATAGATGCACACTTCTTGTCCCAGACCAAGCAGGCAGGAGACAACTTCCCCTACCTGGTAGCATACCA
AGCCACGGTGTGCGCCAGGGCTCAGGCCCCACCTCCATCATGGGATCAAATGTGGAAGTGTCTCATACGG
CTGAAACCTACGCTGCACGGGCCAACACCCTTGCTGTACAGGCTGGGAGCCGTCCAAAATGAGGTCACCC
TCACCCACCCCATAACCAAATACATCATGGCATGCATGTCGGCTGACCTGGAGGTCGTCACTAGCACCTG
GGTGCTGGTGGGCGGAGTCCTTGCAGCTCTGGCCGCGTATTGCCTGACAACAGGCAGTGTGGTCATTGTG
GGTAGGATTATCTTGTCCGGGAGGCCGGCTATTGTTCCCGACAGGGAGCTTCTCTACCAGGAGTTCGATG
AAATGGAAGAGTGCGCCACGCACCTCCCTTACATTGAGCAGGGAATGCAGCTCGCCGAGCAGTTCAAGCA
GAAAGCGCTCGGGTTACTGCAAACAGCCACCAAACAAGCGGAGGCTGCTGCTCCCGTGGTGGAGTCCAAG
TGGCGAGCCCTTGAGACATTCTGGGCGAAGCACATGTGGAATTTCATCAGCGGGATACAGTACTTAGCAG
GCTTATCCACTCTGCCTGGGAACCCCGCAATAGCATCATTGATGGCATTCACAGCCTCTATCACCAGCCC
GCTCACCACCCAAAGTACCCTCCTGTTTAACATCTTGGGGGGTGGGTGGCTGCCCAACTCGCCCCCCCC
AGCGCCGCTTCGGCTTTCGTGGGCGCCGGCATCGCCGGTGCGGCTGTTGGCAGCATAGGCCTTGGGAAGG
TGCTTGTGGACATTCTGGCGGGTTATGGAGCAGGAGTGGCCGGCGCGCTCGTGGCCTTTAAGGTCATGAG
CGGCGAGATGCCCTCTACCGAGGACCTGGTCAATCTACTTCCTGCCATCCTCTCTCCTGGCGCCCTGGTC
GTCGGGGTCGTGTGTGCAGCAATACTGCGTCGGCACGTGGGTCCGGGAGAGGGGCTGTGCAGTGGATGA
ACCGGCTGATAGCGTTCGCCTCGCGGGGTAATCACGTTTCCCCCACGCACTATGTGCCTGAGAGCGACGC
CGCAGCGCGTGTTACTCAGATCCTCTCCAGCCTTACCATCACTCAGCTGCTGAAAAGGCTCCACCAGTGG
ATTAATGAGGACTGCTCCACACCGTGTTCCGGCTCGTGGCTAAGGGATGTTTGGGACTGGATATGCACGG
TGTTGACTGACTTCAAGACCTGGCTCCAGTCCAAGCTCCTGCCGCAGCTACCGGGAGTCCCTTTTTTCTC
GTGCCAACGCGGGTACAAGGGAGTCTGGCGGGGAGACGGCATCATGCAAACCACCTGCCCATGTGGAGCA
CAGATCACCGGACATGTCAAAAACGGTTCCATGAGGATCGTCGGGCCTAAGACCTGCAGCAACACGTGGC
ATGGAACATTCCCCATCAACGCATACACCACGGGCCCCTGCACACCCTCTCCAGCGCCAAACTATTCTAG
GGCGCTGTGGCGGGTGGCCGCTGAGGAGTACGTGGAGGTCACGCGGGTGGGGGATTTCCACTACGTGACG
GGCATGACCACTGACAACGTAAAGTGCCCATGCCAGGTTCCGGCTCCTGAATTCTTCTCGGAGGTGGACG
GAGTGCGGTTGCACAGGTACGCTCCGGCGTGCAGGCCTCTCCTACGGGAGGAGGTTACATTCCAGGTCGG
GCTCAACCAATACCTGGTTGGGTCACAGCTACCATGCGAGCCCGAACCGGATGTAGCAGTGCTCACTTCC
ATGCTCACCGACCCCTCCCACATCACAGCAGAAACGGCTAAGCGTAGGTTGGCCAGGGGGTCTCCCCCCT
CCTTGGCCAGCTCTTCAGCTAGCCAGTTGTCTGCGCCTTCCTTGAAGGCGACATGCACTACCCACCATGT
CTCTCCGGACGCTGACCTCATCGAGGCCAACCTCCTGTGGCGGCAGGAGATGGGCGGGAACATCACCCGC
GTGGAGTCGGAGAACAAGGTGGTAGTCCTGGACTCTTTCGACCCGCTTCGAGCGGAGGAGGATGAGAGGG
AAGTATCCGTTCCGGCGGAGATCCTGCGGAAATCCAAGAAGTTCCCCGCAGCGATGCCCATCTGGGCGCG
CCCGGATTACAACCCTCCACTGTTAGAGTCCTGGAAGGACCCGGACTACGTCCCTCCGGTGGTGCACGGG
TGCCCGTTGCCACCTATCAAGGCCCCTCCAATACCACCTCCACGGAGAAAGAGGACGGTTGTCCTAACAG
AGTCCTCCGTGTCTTCTGCCTTAGCGGAGCTCGCTACTAAGACCTTCGGCAGCTCCGAATCATCGGCCGT
CGACAGCGGCACGGCGACCGCCCTTCCTGACCAGGCCTCCGACGACGGTGACAAAGGATCCGACGTTGAG
TCGTACTCCTCCATGCCCCCCCTTGAGGGGGAACGGGGGACCCCGATCTCAGTGACGGGTCTTGGTCTA
CCGTGAGCGAGGAAGCTAGTGAGGATGTCGTCTGCTGCTCAATGTCCTACACATGGACAGGCGCCTTGAT
CACGCCATGCGCTGCGGAGGAAAGCAAGCTGCCCATCAACGCGTTGAGCAACTCTTTGCTGCGCCACCAT
```

TABLE 15-continued

Sequences of Exemplary Gene Targets

AACATGGTTTATGCCACAACATCTCGCAGCGCAGGCCTGCGGCAGAAGAAGGTCACCTTTGACAGACTGC

AAGTCCTGGACGACCACTACCGGGACGTGCTCAAGGAGATGAAGGCGAAGGCGTCCACAGTTAAGGCTAA

ACTCCTATCCGTAGAGGAAGCCTGCAAGCTGACGCCCCCACATTCGGCCAAATCCAAGTTTGGCTATGGG

GCAAAGGACGTCCGGACCTATCCAGCAAGGCCGTTAACCACATCCACTCCGTGTGGAAGGACTTGCTGG

AAGACACTGTGACACCAATTGACACCACCATCATGGCAAAAAATGAGGTTTTCTGTGTCCAACCAGAGAA

AGGAGGCCGTAAGCCAGCCCGCCTTATCGTATTCCCAGATCTGGGAGTCCGTGTATGCGAGAAGATGGCC

CTCTATGATGTGGTCTCCACCCTTCCTCAGGTCGTGATGGGCTCCTCATACGGATTCCAGTACTCTCCCTG

GGCAGCGAGTCGAGTTCCTGGTGAATACCTGGAAATCAAAGAAAAACCCCATGGGCTTTTCATATGACAC

TCGCTGTTTCGACTCAACGGTCACCGAGAACGACATCCGTGTTGAGGAGTCAATTTACCAATGTTGTGAC

TTGGCCCCCGAAGCCAGACAGGCCATAAAATCGCTCACAGAGCGGCTTTATATCGGGGGTCCTCTGACTA

ATTCAAAAGGGCAGAACTGCGGTTATCGCCGGTGCCGCGCGAGCGGCGTGCTGACGACTAGCTGCGGTAA

CACCCTCACATGTTACTTGAAGGCCTCTGCAGCCTGTCGAGCTGCGAAGCTCCAGGACTGCACGATGCTC

GTGAACGGAGACGACCTTGTCGTTATCTGTGAAAGCGCGGGAACCCAAGAGGACGCGGCGAGCCTACGAG

TCTTCACGGAGGCTATGACTAGGTACTCTGCCCCCCCCGGGACCCGCCCCAACCAGAATACGACTTGGA

GCTGATAACATCATGTTCCTCCAATGTGTCGGTCGCCCACGATGCATCAGGCAAAAGGGTGTACTACCTC

ACCCGTGATCCCACCACCCCCCTCGCACGGGCTGCGTGGGAAACAGCTAGACACACTCCAGTTAACTCCT

GGCTAGGCAACATTATCATGTATGCGCCCACTTTGTGGGCAAGGATGATTCTGATGACTCACTTCTTCTC

CATCCTTCTAGCACAGGAGCAACTTGAAAAAGCCCTGGACTGCCAGATCTACGGGCCTGTTACTCCATT

GAGCCACTTGACCTACCTCAGATCATTGAACGACTCCATGGCCTTAGCGCATTTTCACTCCATAGTTACT

CTCCAGGTGAGATCAATAGGGTGGCTTCATGCCTCAGGAAACTTGGGGTACCACCCTTGCGAGTCTGGAG

ACATCGGGCCAGGAGCGTCCGCGCTAGGCTACTGTCCCAGGGGGGAGGGCCGCCACTTGTGGCAAGTAC

CTCTTCAACTGGGCAGTGAAGACCAAACTCAAACTCACTCCAATCCCGGCTGCGTCCCAGCTGGACTTGT

CCGGCTGGTTCGTTGCTGGTTACAGCGGGGGAGACATATATCACAGCCTGTGTCGTGCCCGACCCCGCTG

GTTCATGCTGTGCCTACTCCTACTTTCTGTAGGGGTAGGCATCTACCTGCTCCCCAACCGATGAACGGGG

AGCTAAACACTCCAGGCCAATAGGCCATTTCCTGTTTTTTTTTTTTTTTTTTTTTTTTTTTCT

TTTCCTTCTTTTTCCCTTTTTCTTTCTTCCTTCTTTAATGGTGGCTCCATCTTAGCGCTAGTCACGGCTA

GCTGTGAAAGGTCCGTGAGCCGCATGACTGCAGAGAGTGCTGATACTGGCCTCTCTGCAGATCATGT gi|306286|gb|M96362.1|HPCUNKCDS Hepatitis C virus mRNA, complete cds
TGCCAGCCCCCGATTGGGGGCGACACTCCACCATAGATCACTCCCCTGTGAGGAACTACTGTCTTCACGC    (SEQ ID NO: 6689)

AGAAAGCGTCTAGCCATGGCGTTAGTATGAGTGTCGTGCAGCCTCCAGGACCCCCCCTCCCGGGAGAGCC

ATAGTGGTCTGCGGAACCGGTGAGTACACCGGAATTGCCAGGACGACCGGGTCCTTTCTTGGATCAACCC

GCTCAATGCCTGGAGATTTGGGCGTGCCCCCGCGAGACTGCTAGCCGAGTAGTGTTGGGTCGCGAAAGGC

CTTGTGGTACTGCCTGATAGGGTGCTTGCGAGTGCCCCGGGAGGTCTCGTAGACCGTGCACCATGAGCAC

GAATCCTAAACCTCAAAGAAAAACCAAACGTAACACCAACCGCCGCCCACAGGATATTAAGTTCCCGGGC

GGTGGTCAGATCGTTGGTGGAGTTTACTTGTTGCCGCGCAGGGGCCCCAGGTTGGGTGTGCGCGCGCGACTA

GGAGACTTCCGAGCGGTCGCAACCTCGTGGAAGGCGACAGCCTATCCCCAAGGCTCGCCGGCCCGAGGG

CAGGGCCTGGGCTCAGCCCGGGTACCCTTGGCCCCTCTATGGCAATGAGGGCTTGGGGTGGGCAGGATGG

CTCCTGTCACCCCGCGGCTCCCGGCCTAGTTGGGGCCCCACGGACCCCCGGCGTAAGTCGCGTAATTTGG

GTAAGGTCATCGACACCCTCACATGCGGCTTCGCCGACCTCATGGGGTACATTCCGCTCGTCGGCGCCCC

TABLE 15-continued

Sequences of Exemplary Gene Targets

CCTAGGGGCGTTGCCAGGGCCCTGGCACATGGTGTCCGGGTGCTGGAGGACGGCGTGAACTATGCAACA

GGGAATCTGCCCGGTTGCTCTTTCTCTATCTTCCTCTTGGCTCTGCTGTCTTGTTTGACCACCCCAGTTT

CCGCTTATGAAGTGCGTAACGCGTCCGGGATGTACCATGTCACGAACGACTGCTCCAACTCAAGCATTGT

GTATGAGGCAGCGGACATGATCATGCACACTCCCGGGTGCGTGCCCTGCGTTCGGGAGGACAACTCCTCC

CGTTGCTGGGTGGCACTTACTCCCACGCTCGCGGCCAGGAATGCCAGCGTCCCCACTACGACATTGCGAC

GCCATGTCGACTTGCTCGTTGGGGTAGCTGCTTTCTGTTCCGCTATGTACGTGGGGGACCTCTGCGGATC

TGTTTTCCTTGTTTCCCAGCTGTTCACCTTTTCGCCTCGCCGGCATGAGACGGTACAGGACTGCAACTGC

TCAATCTATCCCGGCCGCGTATCAGGTCACCGCATGGCCTGGGATATGATGATGAACTGGTCGCCTACAA

CAGCCCTAGTGGTATCGCAGCTACTCCGGATCCCACAAGCTGTCGTGGACATGGTGACAGGGTCCCACTG

GGGAATCCTGGCGGGCCTTGCCTACTATTCCATGGTGGGGAACTGGGCTAAGGTCTTAATTGCGATGCTA

CTCTTTGCCGGCGTTGACGGAACCACCCACGTGACAGGGGGGCGCAAGGTCGGGCCGCTAGCTCGCTAA

CGTCCCTCTTTAGCCCTGGGCCGGTTCAGCACCTCCAGCTCATAAACACCAACGGCAGCTGGCATATCAA

CAGGACCGCCCTGAGCTGCAATGACTCCCTCAACACTGGGTTTGTTGCCGCGCTGTTCTACAAATACAGG

TTCAACGCGTCCGGGTGCCCGGAGCGCTTGGCCACGTGCCGCCCCATTGATACATTCGCGCAGGGGTGGG

GTCCCATCACTTACACTGAGCCTCATGATTTGGATCAGAGGCCCTATTGCTGGCACTACGCGCCTCAACC

GTGTGGTATTGTGCCCACGTTGCAGGTGTGTGGCCCAGTATACTGCTTCACCCCGAGTCCTGTTGCGGTG

GGGACTACCGATCGTTTCGGTGCCCCTACATACAGATGGGGGCAAATGAGACGGACGTGCTGCTCCTTA

ACAACGCCGGGCCGCCGCAAGGCAACTGGTTCGGCTGTACATGGATGAATGGCACTGGGTTCACCAAGAC

ATGTGGGGGCCCCCGTGTAACATCGGGGGGGTCGGCAACAATACCTTGACCTGCCCCACGGACTGCTTC

CGAAAGCACCCCGGGGCCACTTACACCAAATGCGGTTCGGGGCCTTGGTTAACACCCAGGTGCTTAGTCG

ACTACCCGTACAGGCTCTGGCATTACCCCTGCACTGTCAACTTTACCATCTTTAAGGTTAGGATGTACGT

GGGGGGCGCGGAGCACAGGCTCGACGCCGCATGCAACTGGACTCGGGGAGAGCGTTGTGACCTGGAGGAC

AGGGATAGGTCAGAGCTTAGCCCGCTGCTGCTGTCTACAACAGAGTGGCAGGTACTGCCCTGTTCCTTCA

CAACCCTACCGGCTCTGTCCACTGGTTTGATTCATCTCCATCAGAACATCGTGGACATACAATACCTGTA

CGGTATAGGGTCGGCGGTTGTCTCCTTTGCGATCAAATGGGAGTATATTGTGCTGCTCTTCCTTCTTCTG

GCGGACGCGCGCGTCTGCGCTTGCTTGTGGATGATGCTGCTGGTAGCGCAAGCCGAGGCCGCCTTAGAGA

ACCTGGTGGTCCTCAATGCAGCGTCCGTGGCCGGAGCGCATGGCATTCTTTCCTTCATTGTGTTCTTCTG

TGCTGCCTGGTACATCAAGGGCAGGCTGGTTCCCGGAGCGGCATACGCCCTCTATGGCGTATGGCCGCTG

CTTCTGCTTCTGCTGGCGTTACCACCACGGGCGTACGCCATGGACCGGGAGATGGCCGCATCGTGCGGAG

GCGCGGTTTTTGTAGGTCTGGTACTCTTGACCTTGTCACCACACTATAAAGTGTTCCTTGCCAGGTTCAT

ATGGTGGCTACAATATCTCATCACCAGAACCGAAGCGCATCTGCAAGTGTGGGTCCCCCCTCTCAACGTT

CGGGGGGTCGCGATGCCATCATCCTCCTCACATGCGTGGTCCACCCAGAGCTAATCTTTGACATCACAA

AATATTTGCTCGCCATATTCGGCCCGCTCATGGTGCTCCAGGCCGGCATAACTAGAGTGCCGTACTTCGT

GCGCGCACAAGGGCTCATTCGTGCATGCATGTTGGCGCGGAAAGTCGTGGGGGGTCATTACGTCCAAATG

GTCTTCATGAAGCTGGCCGCACTAGCAGGTACGTACGTTTATGACCATCTTACTCCACTGCGAGATTGGG

CTCACACGGGCTTACGAGACCTTGCAGTGGCAGTAGAGCCCGTTGTCTTCTCTGACATGGAGACCAAAGT

CATCACCTGGGGGGCAGACACCGCGGCGTGCGGGGACATCATCTTGGCCCTGCCTGCTTCCGCCCGAAGG

GGGAAGGAGATACTTCTGGGACCGGCCGATAGTCTTGAAGGACAGGGGTGGCGACTCCTTGCGCCCATCA

CGGCCTACTCCCAACAAACGCGAGGCCTGCTTGGTTGCATCATCACTAGCCTTACAGGCCGGGACAAGAA

TABLE 15-continued

Sequences of Exemplary Gene Targets

```
CCAGGTTGAGGGGGAGGTTCAAGTGGTTTCCACCGCAACACAATCTTTCCTGGCGACCTGCATCAATGGC

GTGTGTTGGACTGTCTTCCACGGCGCCGGCTCAAAGACCCTAGCCGGCCCAAAGGGTCCAATCACCCAAA

TGTACACCAATGTAGACCAGGACCTTGTTGGCTGGCCGGCACCTCCTGGGGCGCGTTCCCTGACACCATG

CACTTGCGGCTCCTCGGACCTTTACCTGGTCACGAGACATGCTGATGTCATTCCGGTGCGCCGGCGGGGT

GACGGTAGGGGGAGCCTACTCCCCCCAGGCCTGTCTCGTACTTGAAGGGCTCCTCGGGTGGTCCACTGC

TCTGCCCTTCGGGGCACGCTGTCGGCATACTTCCGGCTGCTGTATGCACCCGGGGGGTTGCCATGGCGGT

GGAATTCATACCCGTTGAGTCTATGGAAACTACTATGCGGTCTCCGGTCTTCACGGACAATCCGTCTCCC

CCGGCTGTACCGCAGACATTCCAAGTGGCCCACTTACACGCTCCCACCGGCAGCGGCAAGAGCACTAGGG

TGCCGGCTGCATATGCAGCCCAAGGGTACAAGGTGCTCGTCCTAAATCCGTCCGTCGCCGCCACCTTGGG

TTTTGGGGCGTATATGTCCAAGGCACATGGTATCGACCCCAACCTTAGAACTGGGGTAAGGACCATCACC

ACAGGTGCCCCTATCACATACTCCACCTATGGCAAGTTCCTTGCCGACGGTGGCGGCTCCGGGGGCGCCT

ATGACATCATAATGTGTGATGAGTGCCACTCAACTGACTCGACTACCATTTATGGCATCGGCACAGTCCT

GGACCAAGCGGAGACGGCTGGAGCGCGGCTCGTGGTGCTCTCCACCGCTACGCCTCCGGGATCGGTCACC

GTGCCACACCTCAATATCGAGGAGGTGGCCCTGTCTAATACTGGAGAGATCCCCTTCTACGGCAAAGCCA

TTCCCATCGAGGCTATCAAGGGGGAAGGCATCTCATTTTCTGCCATTCCAAGAAGAAGTGTGACGAACT

CGCCGCAAAGCTGTCAGGCCTCGGACTCAATGCCGTAGCGTATTACCGGGGTCTTGACGTGTCCGTCATA

CCGACCAGCGGAGACGTTGTTGTCGTGGCGACGGACGCTCTAATGACGGGCTTTACCGGCGACTTTGACT

CAGTGATCGACTGTAATACGTGTGTCACCCAGACAGTCGATTTCAGCTTGGACCCCACCTTCACCATTGA

GACGACGACCGTGCCCCAAGACGCAGTGTCGCGCTCGCAGAGGCGAGGCAGGACTGGTAGGGGCAGGGCT

GGCATATACAGGTTTGTGACTCCAGGAGAACGGCCCTCGGGCATGTTCGATTCTTCGGTCCTGTGTGAGT

GTTATGACGCGGGTTGTGCGTGGTACGAACTCACGCCCGCTGAGACCTCGGTTAGGTTGCGGGCGTACCT

AAACACACCAGGGTTGCCCGTCTGCCAGGACCATCTGGAGTTCTCGGAGGGTGTCTTCACAGGCCTCACC

CACATAGATGCCCACTTCTTATCCCAGACTAAACAGGCAGGAGAGAACTTCCCCTACTTGGTAGCATACC

AGGCTACAGTGTGCGCCAGGGCTCAAGCCCCACCTCCATCGTGGGATGAAATGTGGAGGTGTCTCATACG

GCTGAAACCTACGCTGCACGGGCCAACACCCCTGCTGTATAGGTTAGGAGCCGTCCAAAATGAGGTCACC

CTCACACACCCCATAACCAAATTCATCATGACATGTATGTCGGCTGACCTGGAGGTCGTCACCAGCACCT

GGGTGCTGGTAGGCGGAGTCCTCGCAGCTCTGGCCGCGTACTGCCTGACAACAGGCAGCGTGGTCATTGT

GGGCAGGATCATCCTGTCCGGGAAGCCGGCTATCATCCCCGATAGGGAAGTTCTCTACCAGGAGTTCGAC

GAGATGGAGGAGTGTGCCTCACACCTCCCTTACTTCGAACAGGGAATGCAGCTCGCCGAGCAATTCAAAC

AGAAGGCGCTCGGGTTGCTGCAAACAGCCACCAAGCAGGCGGAGGCTGCTGCTCCCGTGGTGGAGTCCAA

GTGGCGAGCCCTTGAGACCTTCTGGGCGAAGCACATGTGGAACTTCATTAGTGGGATACAGTACTTGGCA

GGCTTGTCCACTCTGCCTGGGAACCCCGCAATACGATCACCGATGGCATTCACAGCCTCCATCACCAGCC

CGCTCACCACCCAGCATACCCTCTTGTTTAACATCTTGGGGGATGGGTGGCTGCCCAACTCGCCCCCCC

CAGCGCTGCCTCAGCTTTCGTGGGCGCCGGCATCGCTGGAGCCGCTGTTGGCACGATAGGCCTTGGGAAG

GTGCTTGTGGACATTCTGGCAGGTTATGGAGCAGGGGTGGCGGGCGCACTTGTGGCCTTTAAGATCATGA

GCGGCGAGATGCCTTCAGCCGAGGACATGGTCAACTTACTCCCTGCCATCCTTTCTCCCGGTGCCCTGGT

CGTCGGGATTGTGTGTGCAGCAATACTGCGTCGGCATGTGGGCCCAGGGGAAGGGGCTGTGCAGTGGATG

AACCGGCTGATAGCGTTCGCCTCGCGGGGTAACCACGTCTCCCCCAGGCACTATGTGCCAGAGAGCGAGC

CTGCAGCGCGTGTTACCCAGATCCTTTCCAGCCTCACCATCACTCAGCTGTTGAAGAGACTCCACCAGTG
```

TABLE 15-continued

Sequences of Exemplary Gene Targets

GATTAATGAGGACTGCTCTACGCCATGCTCCAGCTCGTGGCTAAGGGAGATTTGGGACTGGATCTGCACG

GTGTTGACTGACTTCAAGACCTGGCTCCAGTCCAAGCTCCTGCCGCGATTACCGGGAGTCCCTTTTTTCT

CATGCCAACGCGGGTATAAGGGAGTCTGGCGGGGGGACGGCATCATGCACACCACCTGCCCATGCGGAGC

ACAGATCACCGGACACGTCAAAAACGGTTCCATGAGGATCGTTGGGCCTAAAACCTGCAGCAACACGTGG

TACGGGACATTCCCCATCAACGCGTACACCACGGGCCCCTGCACACCCTCCCCGGCGCCAAACTATTCCA

AGGCATTGTGGAGAGTGGCCGCTGAGGAGTACGTGGAGGTCACGCGGGTGGGAGATTTTCACTACGTGAC

GGGCATGACCACTGACAACGTGAAGTGTCCATGCCAGGTTCCGGCCCCCGAATTCTTCACGGAGGTGGAT

GGAGTGCGGTTGCACAGGTACGCTCCGGCGTGCAGACCTCTCCTACGGGAGGAGGTCGTATTCCAGGTCG

GGCTCCACCAGTACCTGGTCGGGTCACAGCTCCCATGCGAGCCCGAACCGGATGTAGCAGTGCTCACTTC

CATGCTCACTGACCCCTCCCACATTACAGCAGAGACGGCTAAGCGTAGGCTGGCCAGGGGGTCTCCCCCC

TCCTTGGCCAGCTCTTCAGCTAGCCAGTTGTCTGCGCCTTCCTTGAAGGCGACATGCACTACCCATCATG

ACTCCCCGGACGCTGACCTCATTGAGGCCAACCTCTTGTGGCGGCAAGAGATGGGCGGGAACATCACCCG

CGTGGAGTCAGAGAATAAGGTGGTAATCCTGGACTCTTTCGACCCGCTCCGAGCGGAGGATGATGAGGGG

GAAATATCCGTTCCGGCGGAGATCCTGCGGAAATCCAGGAAATTCCCCCAGCGCTGCCCATATGGGCGC

CGCCGGATTACAACCCTCCGCTGCTAGAGTCCTGGAAGGACCCGGACTACGTTCCTCCGGTGGTACACGG

GTGCCCGTTGCCGCCCACCAAGGCCCCTCCAATACCACCTCCACGGAGGAAGAGGACGGTTGTCCTGACA

GAATCCACCGTGTCTTCTGCCTTGGCGGAGCTCGCTACTAAGACCTTCGGCAGCTCCGGATCGTCGGCCA

TCGACAGCGGTACGGCGACCGCCCCTCCTGACCAAGCCTCCGGTGACGGCGACAGAGAGTCCGACGTTGA

GTCGTTCTCCTCCATGCCCCCCCTTGAGGGAGAGCCGGGGGACCCCGATCTCAGCGACGGATCTTGGTCC

ACCGTGAGCGAGGAGGCTAGTGAGGACGTCGTCTGCTGTTCGATGTCCTACACATGGACAGGCGCCCTGA

TCACGCCATGCGCTGCGGAGGAAAGCAAGTTGCCCATCAACCCGTTGAGCAATTCTTTGCTACGTCACCA

CAACATGGTCTATGCTACAACATCCCGCAGCGCAGGCCTGCGGCAGAAGAAGGTCACCTTTGACAGACTG

CAAGTCCTGGACGACCACTACCGGGACGTGCTTAAGGAGATGAAGGCGAAGGCGTCCACAGTTAAGGCTA

AACTTCTATCTGTAGAAGAAGCCTGCAAACTGACGCCCCCACATTCGGCCAAATCCAAATTTGGCTACGG

GGCGAAGGACGTCCGGAGCCTATCCAGCAGGGCCGTTACCCACATCCGCTCCGTGTGGAAGGACCTGCTG

GAAGACACTGAAACACCAATTAGCACTACCATCATGGCAAAAAATGAGGTTTTCTGTGTCCAACCAGAGA

AGGGAGGCCGCAAGCCAGCTCGCCTTATCGTGTTCCCAGATCTGGGAGTTCGTGTATGCGAGAAGATGGC

CCTTTATGACGTGGTCTCCACCCTTCCTCAGGCCGTGATGGGCTCCTCATACGGATTCCAGTACTCTCCT

AAGCAGCGGGTCGAGTTCCTGGTGAATACCTGGAAATCAAAGAAATGCCCCATGGGCTTCTCATATGACA

CCCGCTGTTTTGACTCAACGGTCACTGAGAATGACATCCGTGTTGAGGAGTCAATTTACCAATGTTGTGA

CTTGGCCCCGAAGCCAAACTGGCCATAAAGTCGCTCACAGAGCGGCTCTATATCGGGGTCCCCTGACT

AATTCAAAAGGGCAGAACTGCGGTTACCGCCGGTGCCGCGCGAGCGGCGTGCTGACGACTAGCTGCGGTA

ATACCCTCACATGTTACCTGAAAGCCACTGCGGCCTGTCGAGCTGCGAAGCTCCGGGACTGCACGATGCT

CGTGAACGGAGACGACCTTGTCGTTATCTGTGAAAGCGCGGGAACCCAAGAGGATGCGGCGAGCCTACGA

GTCTTCACGGAGGCTATGACTAGGTACTCTGCCCCCCCTGGGGACCCGCCTCAACCGGAATACGACTTGG

AGTTGATAACATCATGTTCCTCCAATGTGTCGGTCGCACACGATGCATCTGGTAAAAGGGTGTACTACCT

CACCCGTGACCCTACCACCCCCCTTGCACGGGCTGCGTGGGAGACAGCTAGACACACTCCAGTCAACTCC

TGGCTAGGCAACATCATCATGTATGCGCCCACCTTATGGGCAAGGATGATTCTGATGACTCATTTCTTCT

CCATCCTTCTAGCTCAGGAGCAACTTGAAAAAACCCTAGATTGTCAGATCTACGGGGCCTGTTACTCCAT

TABLE 15-continued

Sequences of Exemplary Gene Targets

TGAACCACTTGATCTACCTCAGATCATTGAGCGACTCCATGGTCTTAGCGCATTTTCACTCCATAGTTAC

TCTCCAGGCGAGATCAATAGGGTGGCTTCATGCCTCAGAAAACTTGGGGTACCACCCTTGCGAGCCTGGA

GACATCGGGCCAGAAGTGTCCGCGCTAAGCTACTGTCCCAGGGGGGAGGGCCGCCACTTGTGGCAAGTA

CCTCTTCAACTGGGCGGTGAGGACCAAGCTCAAACTCACTCCAATCCCAGCCGCGTCCCGGTTGGACTTG

TCCGGCTGGTTCGTTGCTGGTTACAGCGGGGGAGACATATATCACAGCCTGTCTCGTGCCCGACCCCGCT

GGTTCATGTTGTGCCTACTCCTACTTTCCGTGGGGGTAGGCATCTACCTGCTCCCCAACCGATGAATGGG

GAGCTAAACACTCCAGGCCAATAGGCCGTTTCTC gi|329739|gb|L02836.1|HPCCGENOM Hepatitis C China virus complete genome
ATTGGGGGCGACACTCCACCATAGATCACTCCCCTGTGAGGAACTACTGTCTTCACGCAGAAAGCGTCTA          (SEQ ID NO: 6690)

GCCATGGCGTTAGTATGAGTGTCGTGCAGCCTCCAGGACCCCCCCTCCCGGGAGAGCCATAGTGGTCTGC

GGAACCGGTGAGTACACCGGAATTGCCAGGACGACCGGGTCCTTTCTTGGATCAACCCGCTCAATGCCTG

GAGATTTGGGCGTGCCCCCGCGAGACTGCTAGCCGAGTAGTGTTGGGTCGCGAAAGGCCTTGTGGTACTG

CCTGATAGGGTGCTTGCGAGTGCCCCGGGAGGTCTCGTAGACCGTGCACCATGAGCACGAATCCTAAACC

TCAAAGAAAAACCAAACGTAACACCAACCGCCGCCCACAGGACGTCAAGTTCCCGGGCGGTGGTCAGATC

GTTGGTGGAGTTTACCTGTTGCCGCGCAGGGGCCCCAGGTTGGGTGTGCGCGCGACTAGGAAGACTTCCG

AGCGGTCGCAACCTCGTGGAAGGCGACAACCTATCCCCAAGGCTCGCCGACCCGAGGGCAGGACCTGGGC

TCAGCCCGGGTATCCTTGGCCCCTCTATGGCAATGAGGGCTTTGGGTGGCAGGATGGCTCCTGTCACCC

CGCGGCTCCCGGCCTAGTTGGGGCCCCACGGACCCCCGGCGTAGGTCGCGTAATTTGGGTAAGGTCATCG

ATACCCTCACATGCGGCTTCGCCGACCTCATGGGGTACATTCCGCTCGTCGGCGCCCCCTTGGGGGGCGC

TGCCAGGGCCCTGGCACATGGTGTCCGGGTTCTGGAGGACGGCGTGAACTATGCAACAGGGAATTTGCCC

GGTTGCTCTTTCTCTATCTTCCTTTTAGCCTTGCTATCCTGTTTGACCACCCCAGCTTCCGCTTACGAAG

TGCGTAACGTGTCCGGGATATACCATGTCACGAACGACTGCTCCAACTCAAGCATTGTGTATGAGGCAGC

GGACCTGATCATGCATACCCCTGGGTGCGTGCCCTGCGTTCGGGAAGGCAACTCCTCCCGTTGCTGGGTA

GCGCTCACTCCCACGCTCGCGGCCAGGAACGCCACGATCCCCACTGCGACAGTACGACGGCATGTCGATC

TGCTCGTTGGGGCGGCTGCTTTCTCTTCCGCCATGTACGTGGGGGATCTCTGCGGATCTGTTTTCCTTGT

CTCTCAGCTGTTCACCTTCTCGCCTCGCCGGTATGAGACAATACAGGACTGCAATTGCTCAATCTATCCC

GGCCACGTAACAGGTCACCGCATGGCTTGGGATATGATGATGAACTGGTCGCCTACAACAGCTCTAGTGG

TGTCGCAGTTACTCCGGATCCCTCAAGCCGTCATGGACATGGTGGTGGGGCCCACTGGGGAGTCCTGGC

GGGCCTTGCCTACTATGCCATGGTGGGAATTGGGCTAAGGTTTTGATTGTGATGCTACTCTTCGCCGGC

GTTGATGGGATACCTACGCGTCTGGGGGGCGCAGGGCCGCTCCACCCTCGGGTTCACGTCCCTCTTTA

CACCTGGGGCCTCTCAGAAGATCCAGCTTATAAATACCAATGGTAGCTGGCATATCAACAGGACTGCCCT

GAACTGCAATGACTCCCTCAATACTGGGTTTCTTGCCGCGCTGTTCTATACACACGGTTCAACGCGTCC

GGATGCGCAGAGCGCATGGCCAGCTGCCGCCCCATTGATACATTCGATCAGGGCTGGGGCCCCATCACTT

ATACTGAGCCTGATAGCTCGGACCAGAGGCCTTATTGCTGGCACTACGCGCCTCGAAAGTGCGGCATCGT

ACCTGCGTCGGAGGTGTGCGGTCCAGTGTATTGTTTCACCCCAAGCCCTGTCGTCGTGGGGACGACCGAT

CGTTTCGGTGTCCCCACATATAGCTGGGGGGAGAATGAGACAGACGTGCTGCTCCTCAACAACACGCGGC

CGCCGCAAGGCAACTGGTTTGGCTGTACATGGATGAATGGCACTGGGTTCACCAAGACGTGCGGGGGGCC

TCCGTGTAACATCGGGGGGGTCGGCAACAACACTTTGACTTGCCCCACGGATTGCTTTCGGAAGCACCCC

GAGGCTACGTATACAAGGTGTGGTTCGGGGCCTTGGCTGACACCTAGGTGCTTAGTTGACTACCCATACA

TABLE 15-continued

Sequences of Exemplary Gene Targets

```
GGCTCTGGCACTACCCCTGCACTGTCAACTTTGCCATCTTCAAAGTTAGGATGTATGTGGGGGGCGTGGA
GCACAGGCTCGATGCTGCATGCAACTGGACTCGAGGAGAGCGCTGTAACTTGGAGGACAGGGATAGATCA
GAACTCAGCCCGCTGCTACTGTCTACAACAGAGTGGCAGATACTACCCTGCGCCTTCACCACCCTACCGG
CTCTGTCCACTGGTTTAATCCATCTCCATCAGAACATCGTGGACGTGCAATACCTGTACGGTATAGGGTC
AGCGGTTGCCTCCTTTGCAATTAAATGGGAGTATGTCTTGTTGCTTTTCCTTCTACTAGCAGACGCGCGC
GTATGTGCCTGCTTGTGGATGATGCTGCTGATAGCCCAGGCCGAGGCCGCCTTAGAGAACCTGGTGGTCC
TCAATGCGGCGTCCGTGGCCGACGCGCATGGCATCCTCTCCTTCCTTGTGTTCTTTTGTGCCGCCTGGTA
CATTAAGGGCAGGCTGGTCCCCGGGGCAGCATACGCTTTCTACGGCGTGTGGCCGCTGCTCCTGCTCCTG
CTGACATTACCACCACGAGCTTACGCCATGGACCGGGAGATGGCTGCATCGTGCGGAGGCGCGGTTTTTG
TAGGTCTGGTATTCCTGACTTTGTCACCATACTACAAGGTGTTCCTCGCTAGGCTCATATGGTGGTTGCA
ATACTTCCTCACCATAGCCGAGGCGCACCTGCAAGTGTGGATCCCCCCTCTCAACATTCGAGGGGGCCGC
GATGCCATCATCCTCCTCACGTGTGCAATCCACCCAGAGTCAATCTTTGACATCACCAAACTCCTGCTCG
CCACGCTCGGTCCGCTCCTGGTGCTTCAGGCTGGCATAACTAGAGTGCCGTACTTTGTGCGCGCTCATGG
GCTCATTCGCGCGTGCATGCTATTGCGGAAAGTTGCTGGGGGTCATTATGTCCAAATGGCCTTCATGAAG
CTGGGCGCACTGACAGGTACGTACGTCTATAACCATCTTACTCCGCTGCAGTATTGGCCACGCGCGGGTT
TACGAGAACTCGCGGTGGCAGTAGAGCCCGTCATCTTCTCTGACATGGAGACCAAGATTATCACCTGGGG
GGCAGACACTGCAGCGTGTGGAGACATCATCTTGGGTTTACCCGTCTCCGCCCGAAGGGGAAAGGAGATA
CTCCTGGGGCCGGCCGATAGTCTTGAAGGGCAGGGGTGGCGACTCCTTGCGCCCATCACGGCCTACTCCC
AACAGACGCGGGGCTTACTTGGTTGCATCATCACTAGCCTCACAGGCCGAGACAAGAACCAGGTCGAGGG
GGAGGTTCAAGTGGTCTCCACCGCAACACAATCTTTCCTGGCGACCTGCATCAACGGTGTGTGTTGGACT
GTCTATCATGGCGCCGGCTCAAAAACCTTAGCCGGCCCAAAGGGCCCAATCACCCAAATGTACACCAATG
TAGACCAGGACCTCGTCGGCTGGCACCGGCCCCCCGGGGCGCGTTCCCTAACACCATGCACCTGCGGCAG
CTCGGACCTTTACTTGGTCACGAGACATGCTGATGTCATTCCGGTGCGCCGTCGAGGCGACAGTAGGGGG
AGTTTACTCTCCCCCAGGCCTGTCTCCTACCTGAAGGGCTCGTCGGGGGGCCCACTGCTCTGCCCCTTCG
GGCACGTTGCAGGCATCTTCCGGGCTGCTGTGTGCACCCGGGGGGTTGCGAAGGCGGTGGATTTTATACC
CGTTGAGACCATGGAAACTACCATGCGGTCCCCGGTCTTCACGGACAACTCATCCCCTCCTGCCGTACCG
CAGACATTCCAAGTGGCCCATCTACACGCTCCCACTGGCAGCGGCAAAAGCACCAAGGTGCCGGCTGCAT
ATGCAGCCCAAGGGTACAAGGTACTTGTCTTGAACCCGTCTGTTGCCGCCACTTTAGGTTTTGGGGCGTA
TATGTCTAAGGCACATGGTGTCGACCCCAACATTAGAACCGGGGTAAGGACCATCACCACGGGCGCCCCC
ATCACATACTCTACCTATGGCAAGTTCCTTGCTGATGGTGGTTGCTCTGGGGGTGCCTATGACATTATAA
TATGTGATGAGTGCCATTCAACTGACTCGACTACCATCTTGGGCATCGGCACGGTCCTGGACCAAGCGGA
GACGGCTGGAGCGCGGCTTGTCGTGCTCGCCACCGCTACGCCTCCGGGATCGGTCACCGTGCCACATCCA
AACATCGAGGAGGTGGCCCTGTCCAATACTGGAGAGATCCCCTTCTATGGTAAAGCCATCCCCATCGAAG
CCATCAGGGGGGAAGGCATCTCATTTTCTGCCACTCCAAGAAGAAGTGTGACGAGCTTGCTGCAAAGCT
ATCATCGCTCGGGCTCAACGCTGTGGCGTACTACCGGGGGCTTGATGTGTCCGTCATACCATCTAGCGGA
GACGTCGTTGTCGTGGCAACGGACGCTCTAATGACGGGCTTTACGGGCGACTTTGACTCAGTGATCGACT
GTAACACATGTGTTACCCAAACAGTCGATTTCAGCTTGGACCCCACCTTCACCATCGAGACAACGACCGT
GCCCCAAGACGCGGTGTCGCGCTCGCAGCGGCGAGGTAGGACTGGCAGGGGTAGGGAAGGCATCTACAGG
TTTGTTACTCCAGGAGAACGGCCCTCGGGCATGTTCGACTCCTCAGTCCTGTGTGAGTGCTATGACGCGG
```

TABLE 15-continued

Sequences of Exemplary Gene Targets

```
GCTGTGCTTGGTACGAGCTCACGCCGGCTGAGACCACGGTTAGGTTGCGGGCTTACCTAAATACACCAGG
GTTGCCCGTCTGCCAGGACCATCTGGAGTTCTGGGAGGGCGTCTTCACAGGTCTCACCCATATAGACGCT
CACTTTCTGTCCCAGACCAAGCAAGCAGGAGACAACTTCCCCTACCTGGTAGCATACCAAGCTACAGTGT
GTGCCAAGGCTCAGGCCCCACCTCCATCGTGGGATCAAATGTGGAAGTGCCTCACACGGGTAAAGCCTAC
GCTGCAGGGACCAACACCCCTGCTGTATAGGCTAGGAGCCGTCCAAAATGAGGTCACCCTCACACACCCC
ATAACTAAATACATCATGACATGCATGTCGGCTGACCTGGAGGTCGTCACCAGCACCTGGGTGCTGGTGG
GCGGAGTCCTTGCAGCTCTGGCCGCGTATTGCCTGACAACGGGCAGCGTGGTCATTGTGGGTAGGATTGT
CTTGTCCGGAAGTCCGGCTATTGTTCCTGACAGGGAAGTTCTTTACCAAGACTTCGACGAGATGGAAGAG
TGTGCCTCACACCTCCCTTACATCGAACAGGGAATGCAGCTCGCCGAGCAGTTCAAGCAGAAGGCGCTCG
GGTTGCTGCAAACAGCCACCAAGCAAGCGGAGGCTGCTGCTCCCGTGGTGGAGTCCAAGTGGCGAGCCCT
CGAGACATTTTGGGAAAAACACATGTGGAATTTCATCAGCGGGATACAGTACTTAGCAGGCTTATCCACT
CTGCCTGGGAACCCCGCAATGGCATCACTGATGGCATTCACAGCTTCTATCACCAGCCCGCTCACTACCC
AACACACCCTCCTGTTTAACATCTTGGGTGGATGGGTGGCTGCCCAACTCGCTCCCCCCAGCGCCGCTTC
GGCCTTTGTGGGCGCCGGCATTGCCGGTGCGGCTGTTGGCAGCATAGGCCTTGGGAAGGTGCTTGTGGAC
ATCCTGGCGGGTTATGGGGCGGGGTGGCTGGCGCACTCGTGGCCTTTAAGGTCATGAGTGGCGAAATGC
CCTCCACTGAGGACCTGGTTAATTTACTCCCTGCCATCCTCTCTCCTGGTGCCCTAGTCGTCGGGGTCGT
GTGCGCAGCAATACTGCGCCGACACGTGGGCCCGGGAGAGGGGGCTGTGCAGTGGATGAACCGGCTGATA
GCGTTCGCTTCGCGGGGTAACCATGTCTCCCCCACGCACTATGTGCCTGAAAGTGACGCCGCAGCGCGTG
TTACCCAGATCCTCTCCAGCCTTACCATCACTCAGCTGCTGAAAAGACTTCACCAGTGGATTAATGAGGA
CTGTTCCACACCATGCTCCGGCTCGTGGCTAAGGGATGTTTGGGATTGGATATGCACGGTGTTGACCGAT
TTCAAGACCTGGCTCCAGTCCAAGCTCCTGCCGCGGTTGCCCGGAGTCCCTTTCCTCTCATGCCAACGCG
GGTACAAGGGAGTCTGGCGGGGGGACGGTATTATGCAAACCACCTGTCCATGTGGAGCACAGATTACTGG
ACATGTCAAAAACGGTTCCATGAGAATCGTTGGGCCTAAGACTTGTAGCAACACGTGGCATGGAACATTC
CCCATCAACGCGTACACCACGGGCCCCTGCACACCCTCCCCGGCGCCGAACTATTCCAGGGCGCTGTGGC
GGGTGGCTCCTGAGGAGTACGTGGAGGTTACGCGGGTGGGGATTTCCACTACGTGACGGGCATGACCAC
CGACAACGTGAAATGCCCATGCCAAGTCCCGGCCCCTGAATTCTTCACGGAGGTGGATGGAGTACGGCTG
CACAGGTACGCTCCGGCGTGCAAACCTCTCCTACGGGAGGAGGTCGTGTTCCAGGTCGGGCTCAACCAAT
ACCTGGTTGGATCACAGCTCCCATGCGAGCCCGAGCCGGACGTAACAGTGCTCACTTCCATGCTTACCGA
CCCCTCCCACATCACAGCAGAGACGGCCAAGCGTAGGCTGGCCAGGGGGTCTCCCCCCTCCTTGGCCAGC
TCTTCAGCTAGCCAATTGTCTGCGCCTTCTTTGAAGGCGACATGTACTACCCATCATGACTCCCCGGACG
CCGACCTCATTGAGGCCAACCTCCTGTGGCGGCAGGAGATGGGCGGAAACATCACCCGTGTGGAGTCAGA
AAATAAGGTAGTGATCCTGGACTCTTTCGACCCGCTTCGGGCGGAGGAGGACGAGAGGGAAGTATCCGTT
GCGGCGGAGATCCTGCGGAAATCCAGGAAGTTCCCCTCAGCGCTGCCCATATGGGCACGCCCAGACTACA
ACCCTCCACTGCTAGAGTCCTGGAAGGACCCAGATTATGTCCCTCCGGTGGTACACGGGTGCCCGTTGCC
GCCTACCACGGCCCCTCCAGTACCACCTCCACGGAGAAAAAGGACGGTCGTCCTAACAGAGTCATCCGTG
TCTTCTGCCTTGGCGGAGCTCGCTACTAAGACCTTCGGCAGCTCTGAATCGTCGGCCGTCGACAGCGGCA
CGGCGACTGCCCCTCCTGACGAGGCCTCCGGCGGCGGCGACAAAGGATCCGACGTTGAGTCGTACTCCTC
CATGCCCCCCCTTGAGGGAGAGCCGGGGGACCCCGACCTCAGCGACGGGTCCTGGTCTACCGTGAGTGAG
GAGGCCAGTGAGGACGTCGTCTGCTGCTCAATGTCCTATACATGGACAGGCGCCTTGATCACGCCATGTG
```

TABLE 15-continued

Sequences of Exemplary Gene Targets

CTGCGGAGGAGAGCAAGCTGCCCATCAACCCGCTGAGCAACTCCTTGCTGCGTCACCACAACATGGTCTA

TGCTACAACATCCCGCAGTGCAAGCCTACGGCAGAAGAAGGTCGCTTTTGACAGAATGCAAGTCCTGGAC

GACCATACCGGGACGTGCTCAAGGAGATGAAGGCGAAGGCGTTCCACAGTTAAGGCTAAACTCCTATCCA

TAGAAGAGGCCTGCAAGCTGACGCCCCCACATTCAGCCAAATCCAAATTTGGCTATGGGGCAAAAGACGT

CCGGAACCTATCCAGCAAGGCCGTTAACCACATCCGCTCCGTGTGGAAGGACTTGTTGGAAGACAATGAG

ACACCAATCAATACCACCATCATGGCAAAAAATGAGGTTTTCTGCGTCCAACCAGAGAAAGGAGGCCGTA

AGCCAGCTCGCCTTATCGTATTCCCAGACTTGGGAGTCCGTGTGTGCGAGAAGATGGCCCTTTATGACGT

GGTCTCCACCCTTCCTCAGCCCGTGATGGGCTCCTCATACGGATTCCAGTACTCTCCTGGGCAGCGGGTC

GAATTCCTGCTAAATGCCTGGAAATCAAAGGAAAACCCTATGGGCTTCTCATATGACACCCGCTGTTTTG

ACTCAACGGTCACTCAGAACGACATCCGTGTTGAGGAGTCAATTTACCAATGTTGTGACTTGGCCCCCGA

GGCCAGACGGGCCATAAAGTCGCTCACAGAGCGGCTCTATATCGGGGGTCCCCTGACTAATTCAAAAGGG

CAGAACTGCGGTTATCGCCGGTGCCGCGCAAGTGGCGTGCTGACGACCAGCTGCGGTAATACCCTTACAT

GTTACTTGAAGGCCTCTGCGGCCTGTCGAGCTGCGAAGCTGCAGGACTGCACGATGCTCGTGAACGGAGA

CGACCTTGTCGTTATCTGTGAAAGCGCGGGAACTCAAGAGGATGCGGCGAGCCTACGAGTCTTCACGGAG

GCTATGACTAGGTACTCTGCCCCCCCTGGGGACCTGCCCAACCAGAATACGACTTGGAGCTAATAACAT

CATGCTCCTCCAATGTGTCAGTCGCCCACGATGCATCTGGCAAAAGGGTGTACTACCTCACCCGTGACCC

CACCATCCCCCTCGCGCGGCTGCGTGGGAGACAGCTAGACACACTCCAGTCAACTCCTGGCTAGGCAAC

ATCATCATGTATGCGCCCACTCTATGGGCAAGGATGATTCTGATGACTCACTTCTTCTCCATCCTTCTAG

CTCAGGAGCAACTTGAGAAAGCCCTGGATTGCCAAATCTACGGGCCTACTACTCCATTGAGCCACTTGA

CCTACCTCAGATCATTGAACGACTCCATGGCCTTAGCGCATTTTCACTCCATAGTTACTCTCCAGGTGAG

ATCAATAGGGTGGCGTCATGTCTCAGGAAACTTGGGGTACCACCCTTGCGAGTCTGGAGACATCGGGCCA

GAAGCGTCCGCGCTAAGCTACTGTCCCAGGGGGGAGGGCCGCCACTTGTGGCAAGTACCTCTTCAACTG

GGCAGTAAAGACCAAGCTTAAACTCACTCCAATCCCGGCTGCGTCCCGGTTGGACTTGTCCGGCTGGTTC

GTTGCTGGTTACAGCGGGGGAGACATATATCACAGCCTGTCTCGTGCCCGACCCCGTTGGTTCATGTTGT

GCCTACTCCTACTTTCTGTAGGGGTAGGCATCTACCTGCTCCCCAACCGATGAACGGGGAGATAAACACT

CCAGGCCAATAGGCCATCCC gi|15422182|gb|AY051292.1| Hepatitis C virus from India
polyprotein mRNA, complete cds
GCCAGCCCCCTGATGGGGGCGACACTCCACCATAGATCACTCCCCTGTGAGGAACTACTGTCTTCACGCA  (SEQ ID NO: 6691)

GAAAGCGTCTAGCCATGGCGTTAGTATGAGTGTCGTGCAGCCTCCAGGACCCCCCCTCCCGGGAGAGCCA

TAGTGGTCTGCGGAACCGGTGAGTACACCGGAATTGCCAGGACGACCGGGTCCTTTCTTGGATCAACCCG

CTCAATGCCTGGAGATTTGGGCGTGCCCCCGCAAGACTGCTAGCCGAGTAGTGTTGGGTCGCGAAAGGCC

TTGTGGTACTGCCTGATAGGGTGCTTGCGAGTGCCCCGGGAGGTCTCGTAGACCGTGCACCATGAGCACG

AATCCTAAACCTCAAAGAAAAACCAAACGTAACACCAACCGACGCCCACAGAACGTTAAGTTCCCGGGTG

GCGGCCAGATCGTTGGCGGAGTTTGCTTGTTGCCGCGCAGGGGTCCCAGAGTGGGTGTGCGCGCGACGAG

GAAGACTTCCGAGCGGTCACAACCTCGCGGAAGGCGTCAGCCTATTCCCAAGGCCCGCCGACCCGAGGGC

AGGTCCTGGGCGCAGCCCGGGTACCCTTGGCCCCTCTATGGCAACGAGGGCGTGGGTGGGCAGGATGGC

TCTTGTCCCCCGCGGCTCCCGGCCTAGTCGGGGCCCCTCTGACCCCCGGCGCAGGTCACGCAATTTGGG

TAAGGTCATCGATACCCTCACGTGTGGCTTCGCCGACCTCATGGGGTACATCCCGCTCGTCGGTGCTCCT

CTAGGGGGCGCTGCTAGGGCTCTGGCACATGGTGTTAGGGTTCTAGAAGACGGCGTAAATTACGCAACAG

TABLE 15-continued

Sequences of Exemplary Gene Targets

GGAACCTTCCTGGTTGCTCTTTTTCTATCTTCTTGCTTGCTCTTCTCTCCTGCTTGACAGTCCCTGCTTC

GGCCGTCGAAGTGCGCAACTCTTCGGGGATCTACCATGTCACCAATGATTGCCCCAATGCGTCTGTTGTG

TACGAGACAGATAGCTTGATCATACATCTGCCCGGGTGTGTGCCCTGCGTACGCGAGGGCAACGCTTCGA

GGTGCTGGGTCTCCCTTAGTCCTACTGTTGCCGCTAAGGATCCGGGCGTCCCCGTCAACGAGATTCGGCG

TCACGTCGACCTGATTGTCGGGGCCGCTGCATTCTGTTCGGCTATGTATGTAGGGGACTTATGCGGTTCC

ATCTTCCTCGTTGGCCAGCTTTTCACCCTCTCCCCTAGGCGCCACTGGACAACACAAGACTGTAATTGCT

CCATCTACCCAGGACATGTGACAGGCCATCGAATGGCTTGGGACATGATGATGAATTGGTCACCTACTGG

CGCTTTGGTGGTAGCGCAGCTACTCCGGATCCCACAAGCCGTCTTGGATATGATAGCCGGTGCCCACTGG

GGTGTCCTAGCGGGCCCGGCATACTACTCCATGGTGGGGAACTGGGCTAAGGTTTTGGTTGTGCTACTGC

TCTTCGCTGGCGTCGATGCAACCACCCAAGTCACAGGTGGCACCGCGGGCCGTAATGCATATAGATTGGC

TAGCCTCTTCTCCACCGGCCCCAGCCAAAATATCCAGCTCATAAACTCCAATGGCAGCTGGCACATTAAC

AGGACTGCCCTGAATTGCAATGACAGCCTGCACACCGGCTGGGTAGCAGCGCTGTTCTACTCCCACAAGT

TCAACTCTTCGGGGCGTCCTGAGAGGATGGCTAGTTGTCGGCCTCTTACCGCCTTCGACCAAGGGTGGGG

GCCCATCACTTACGGGGGGAAAGCTAGTAACGACCAGCGGCCGTATTGCTGGCACTATGCCCCACGCCCG

TGCGGTATCGTGCCGGCGAAAGAGGTTTGCGGGCCTGTATACTGTTTCACACCCAGTCCCGTGGTAGTGG

GGACGACGGACAAGTACGGCGTTCCTACCTACACATGGGGCGAGAATGAGACGGATGTACTGCTCCTTAA

CAACTCTAGGCCGCCAATAGGGAATTGGTTCGGGTGTACGTGGATGAATTCCACTGGTTTCACCAAGACG

TGCGGGGCTCCTGCCTGTAACGTCGGCGGGAGCGAGACCAACACCCTGTCGTGCCCCACAGATTGCTTCC

GCAGACATCCGGACGCAACATACGCTAAGTGCGGCTCTGGCCCTTGGCTTAACCCTCGATGCATGGTGGA

CTACCCTTACAGGCTCTGGCACTATCCCTGCACAGTCAATTACACCATATTCAAGATCAGGATGTTCGTG

GGCGGGATTGAGCACAGGCTCACCGCCGCGTGCAACTGGACGCGGGGAGAGCGCTGCGACTTGGACGACA

GGGATCGTGCCGAGTTGAGCCCGCTGTTGCTGTCCACCACGCAATGGCAGGTCCTCCCCTGCTCATTCAC

AACGCTGCCCGCCCTGTCAACTGGCCTAATACATCTCCACCAGAACATCGTGGACGTGCAGTACCTCTAC

GGGTTGAGCTCGGTAGTTACATCCTGGGCCATAAGGTGGGAGTATGTCGTGCTCCTTTTCTTGCTGTTAG

CAGATGCCCGCATTTGTGCCTGCCTTTGGATGATGCTTCTCATATCCCAGGTAGAGGCGGCGCTGGAGAA

CCTGATAGTCCTCAACGCTGCTTCCCTGGCTGGGACACACGGCATCGTCCCTTTCTTCATCTTTTTTTGT

GCAGCCTGGTATCTGAAAGGCAAGTGGGCCCCTGGACTCGTCTACTCCGTCTACGGAATGTGGCCGCTGC

TCCTGCTTCTCCTGGCGTTGCCCCAACGGGCGTACGCCTTGGATCAGGAGTTGGCCGCGTCGTGTGGGC

CGTGGTCTTCATCAGCCTAGCGGTACTTACCCTGTCGCCGTACTACAAACAGTACATGGCCCGCGGCATC

TGGTGGCTGCAGTACATGCTGACCAGAGCGGAGGCGCTCCTGCACGTCTGGGTCCCCTCGCTCAACGCCC

GGGGAGGGCGTGATGGTGCCATACTGCTCATGTGTGTGCTCCACCCGCACTTGCTCTTTGACATCACCAA

AATCATGCTGGCCATTCTCGGGCCCCTGTGGATCTTGCAGGCCAGTCTGCTCAGGGTGCCGTACTTCGTG

CGCGCCCACGGTCTCATTAGGCTCTGCATGCTGGTGCGCAAAACAGCGGGCGGTCACTATGTGCAGATGG

CTCTGTTGAAGCTGGGGGCACTTACTGGCACTTACATTTACAACCACCTTTCCCCACTCCAAGACTGGGC

TCATGGCAGCTTGCGTGATCTAGCGGTGGCCACCGAGCCCGTCATCTTCTCCCGGATGGAGATCAAGACT

ATCACCTGGGGGGCAGACACCGCGGCCTGTGGAGACATCATCAACGGGCTGCCTGTTTCTGCTCGGAGGG

GGAGAGAGGTGTTGTTGGGACCAGCCGATGCCCTGACTGACAAGGGATGGAGGCTTTTAGCCCCCATCAC

AGCTTACGCCCAACAGACACGAGGTCTCTTGGGCTGTATTGTCACCAGCCTCACCGGTCGGGACAAAAAT

CAAGTGGAGGGGGAAATCCAGATTGTGTCTACCGCAACCCAGACGTTCTTGGCCACTTGCATCAACGGAG

TABLE 15-continued

Sequences of Exemplary Gene Targets

```
CTTGCTGGACTGTTTATCATGGGGCCGGATCGAGGACCATCGCTTCGGCGTCGGGTCCTGTGGTCCGGAT
GTACACCAATGTGGACCAGGATTTGGTGGGCTGGCCAGCGCCTCAGGGAGCGCGCTCCCTGACGCCGTGC
ACGTGCGGTGCCTCGGATCTGTACTTGGTCACGAGGCACGCGGATGTCATCCCAGTGCGGCGTCGAGGCG
ATAACAGGGGAAGCTTGCTTTCTCCCCGGCCCATCTCATACCTAAAAGGATCCTCGGGAGGCCCTCTGCT
CTGCCCCATGGGACATGTCGCGGGCATTTTTAGGGCCGCGGTGTGCACCCGTGGGGTTGCAAAGGCGGTC
GACTTTGTGCCCGTTGAGTCCTTAGAGACCACCATGAGGTCCCCAGTGTTTACTGACAATTCCAGCCCTC
CAACAGTGCCCCAGAGTTACCAGGTGGCACATCTACATGCACCCACTGGGAGTGGCAAGAGCACGAAGGT
GCCGGCCGCTTACGCAGCTCAAGGGTACAAGGTACTTGTGCTGAACCCGTCTGTTGCTGCCACCTTAGGG
TTCGGTGCTTATATGTCAAAGGCCCATGGGATTGACCCAAACGTCAGGACCGGCGTGAGGACCATTACCA
CAGGCTCCCCCATCACCTACTCCACCTACGGGAAATTTTTGGCTGATGGCGGATGCCCAGGAGGTGCGTA
CGACATCATAATATGTGACGAATGTCACTCAGTGGACGCCACCTCGATTCTGGGCATAGGGACCGTCTTG
GACCAAGCGGAGACGGCGGGGGTTAGGCTCACTGTCCTTGCCACCGCTACACCACCTGGCTTGGTCACCG
TGCCACATTCCAACATCGAGGAAGTTGCACTGTCCGCTGACGGGAGAAACCATTTTATGGTAAGGCCAT
CCCCCTAAACTACATCAAGGGGGGAGGCATCTCATTTTCTGTCATTCCAAGAAGAAGTGCGACGAGCTC
GCTGCAAAGCTGGTCGGTCTGGGCGTCAACGCGGTGGCCTTTTACCGTGGCCTCGACGTATCTGTCATTC
CAACTACAGGAGACGTCGTTGTTGTAGCGACCGACGCCTTGATGACTGGCTTCACCGGCGATTTCCACTC
TGTGATAGACTGCAACACCTGTGTCGTCCAGACAGTCGACTTCAGCCTAGACCCTATATTCTCTATTGAG
ACTTCCACCGTGCCCCAGGACGCCGTGTCCCGCTCCCAACGGAGGGGTAGGACCGGTCGAGGGAAGCATG
GTATTTACAGATATGTGTCACCCGGGGAGCGGCCGTCTGGCATGTTCGACTCCGTGGTCCTCTGTGAGTG
CTATGACGCGGGTTGTGCTTGGTACGAGCTTACACCCGCCGAGACCACAGTCAGGCTACGGGCATACCTT
AACACCCCAGGATTGCCCGTGTGCCAGGACCACTTGGAGTTCTGGGAGAGTGTCTTCACCGGCCTCACCC
ACATAGATGCCCACTTCCTGTCCCAGACGAAACAGAGTGGGGAGAACTTCCCCTACCTAGTCGCATACCA
AGCCACCGTGTGCGCTAGAGCTAGAGCTCCTCCCCCGTCATGGGACCAAATGTGGAAGTGCCTGATACGG
CTCAAGCCCACCCTCACTGGGGCTACCCCATTACTATACAGACTGGGTAGTGTACAGAATGAGATCACCT
TAACACACCCAATCACCCAATACATCATGGCTTGCATGTCGGCGGACCTGGAGGTCGTCACTAGCACGTG
GGTGTTGGTGGGCGGCGTCCTAGCCGCTTTGGCCGCTTACTGCCTGTCCACAGGCAGCGTGGTCATAGTG
GGCAGGATAATCCTAGGTGGGAAGCCGGCAGTCATACCTGACAGGGAGGTTCTCTACCGAGAGTTTGATG
AGATGGAGGAGTGCGCCGCCCACGTCCCCTACCTCGAGCAGGGGATGCATTTGGCTGGACAGTTCAAGCA
GAAAGCTCTCGGGTTGCTCCAGACAGCATCCAAGCAAGCGGAGACGATCACTCCCACTGTCCGCACCAAC
TGGCAGAAACTCGAGTCCTTCTGGGCTAAGCACATGTGGAACTTCGTTAGCGGGATACAATACCTGGCGG
GCCTGTCAACGCTGCCCGGGAACCCCGCTATAGCGTCGCTGATGTCGTTTACGGCCGCGGTGACGAGTCC
ACTAACCACCCAGCAAACCCTCTTCTTTAACATCTTAGGGGGTGGGTGGCGGCCCAGCTTGCTTCCCCA
GCTGCCGCTACTGCTTTTGTCGGTGCTGGTATTACTGGCGCCGTTGTTGGCAGTGTGGGCCTAGGGAAGG
TCCTAGTGGACATTATTGCTGGCTACGGGGCTGGTGTGGCGGGGCCCTCGTGGCTTTCAAAATCATGAG
CGGGGAGACCCCCACCACCGAGGATCTAGTCAACCTTCTGCCTGCCATCCTATCGCCAGGAGCTCTCGTT
GTCGGCGTGGTGTGCGCAGCAATACTACGCCGGCACGTGGGCCCTGGCGAGGGCGCCGTGCAGTGGATGA
ACCGGCTGATAGCGTTTGCTTCTCGGGGTAACCACGTCTCCCCTACACACTACGTGCCGGAGAGCGACGC
GTCGGCTCGTGTCACACAAATTCTCACCAGCCTCACTGTTACTCAGCTTCTGAAAAGGCTCCACGTGTGG
ATAAGCTCGGATTGCATCGCCCCGTGTGCTAGTTCTTGGCTTAAAGATGTCTGGGACTGGATATGCGAGG
```

TABLE 15-continued

Sequences of Exemplary Gene Targets

```
TGCTGAGCGACTTCAAGAATTGGCTGAAGGCCAAACTTGTACCACAACTGCCCGGGATCCCATTCGTATC
CTGCCAACGCGGGTACCGTGGGGTCTGGCGGGGCGAGGGCATCGTGCACACTCGTTGCCCGTGTGGGGCC
AATATAACTGGACATGTCAAGAACGGTTCGATGAGAATCGTCGGGCCTAAGACTTGCAGCAACACCTGGC
GTGGGTCGTTCCCCATTAACGCTTACACTACAGGCCCGTGCACGCCCTCCCCGGCGCCGAACTATACGTT
CGCGCTATGGAGGGTGTCTGCAGAGGAGTATGTGGAGGTAAGGCGGCTGGGGGACTTCCATTACGTCACG
GGGGTGACCACTGATAAACTCAAGTGTCCATGCCAGGTCCCCTCACCCGAGTTCTTCACAGAGGTGGACG
GGGTGCGCCTGCATAGGTACGCCCCCCCCTGCAAACCCCTGCTGCGAGAAGAGGTGACGTTTAGCATCGG
GCTCAATGAATACTTGGTGGGGTCCCAGTTGCCCTGCGAGCCCGAGCCAGACGTAGCTGTACTGACATCA
ATGCTTACAGACCCCTCCCACATCACTGCAGAGACGGCAGCGCGTAGGCTGAAGCGGGGGTCTCCCCCCT
CCCTGGCCAGCTCTTCCGCCAGCCAGCTGTCCGCGCCGTCACTGAAGGCAACATGCACCACTCACCACGA
CTCTCCAGACGCTGACCTCATAGAAGCCAACCTCCTGTGGAGACAGGAGATGGGGGGAACATCACTAGG
GTGGAGTCGGAGAACAAGATTGTCGTTCTGGATTCTTTCGACCCGCTCGTAGCGGAGGAGGATGATCGGG
AGATCTCTATTCCAGCTGAGATTCTGCGGAAGTTCAAGCAGTTTCCTCCCGCTATGCCCATATGGGCACG
GCCAGATTATAATCCTCCCCTTGTGGAACCGTGGAAGCGCCCGGACTATGAGCCACCCTTAGTCCACGGG
TGCCCCCTACCACCTCCCAAGCCAACTCCGGTGCCGCCACCCCGGAGAAAGAGGACGGTGGTGCTGGACG
AGTCTACAGTATCATCTGCTCTGGCTGAGCTTGCCACTAAGACCTTCGGCAGCTCTACAACCTCAGGCGT
GACAAGTGGTGAAGCGACTGAATCGTCCCCGGCGCCCTCCTGCGGCGGTGAGCTGGACTCCGAAGCTGAA
TCTTACTCCTCCATGCCCCCTCTCGAGGGGGAGCCGGGGGACCCCGATCTCAGCGACGGGTCTTGGTCTA
CCGTGAGCAGTGATGGTGGCACGGAAGACGTTGTGTGCTGCTCGATGTCTTACTCGTGGACGGGCGCTTT
AATCACGCCCTGTGCCTCAGAGGAAGCCAAGCTCCCTATCAACGCATTGAGCAACTCGCTGCTGCGCCAC
CACAACTTGGTGTATTCCACCACCTCTCGCAGCGCTGGCCAGAGACAGAAAAAGTCACATTTGACAGAG
TGCAAGTCCTGGACGACCATTACCGGGACGTGCTCAAGGAGGCTAAGGCCAAGGCATCCACGGTGAAGGC
TAGACTGCTATCCGTTGAGGAAGCGTGTAGCCTGACGCCCCCACACTCCGCCAGATCAAAATTTGGCTAT
GGGGCGAAGGATGTCCGAAGCCATTCCAGTAAGGCTATACGCCACATCAACTCCGTGTGGCAGGACCTTC
TGGAGGACAATACAACACCCATAGACACTACCATCATGGCAAAGAATGAGGTCTTCTGTGTGAAGCCCGA
AAAGGGGGGCCGCAAGCCCGCTCGTCTTATCGTGTACCCCGACCTGGGAGTGCGCGTATGCGAGAAGAGG
GCTTTGTATGACGTAGTCAAACAGCTCCCCATTGCCGTGATGGGAGCCTCCTACGGGTTCCAGTACTCAC
CAGCGCAGCGGGTCGACTTCCTGCTTAAAGCGTGGAAAATCTAAGAAAGTCCCCATGGGGTTTTCCTATGA
CACCCGTTGCTTTGACTCAACAGTCACTGAGGCTGATATCCGTACGGAGGAAGACCTCTACCAATCTTGT
GACCTGGCCCCTGAGGCTCGCATAGCCATAAGGTCCCTCACAGAGAGGCTTTACATCGGGGGCCCACTCA
CCAATTCTAAGGGACAAAACTGCGGCTATCGGCGATGCCGCGCAAGCGGCGTGCTGACCACTAGCTGCGG
TAACACCATAACCTGCTTCCTCAAAGCCAGTGCAGCCTGTCGAGCTGCGAAGCTCCAGGACTGCACCATG
CTCGTGTGCGGCGACGACCTCGTCGTTATCTGTGAGAGCGCCGGTGTCCAGGAGGACGCTGCGAGCCTGA
GAGCCTTCACGGAGGCTATGACCAGGTACTCCGCCCCCCCGGGAGACCCGCCTCAACCAGAATACGACTT
GGAGCTTATAACATCCTGCTCCTCCAATGTGTCGGTCGCGCGCGACGGCGCTGGCAAAAGGGTCTATTAT
CTGACCCGTGACCCTGAGACTCCCCTCGCGCGTGCCGCTTGGGAGACAGCAAGACACACTCCAGTGAACT
CCTGGCTAGGCAACATCATCATGTTTGCCCCCACTCTGTGGGTACGGATGGTCCTCATGACCCATTTTTT
CTCCATACTCATAGCTCAGGAGCACCTTGGAAAGGCTCTAGATTGTGAAATCTATGGAGCCGTACACTCC
GTCCAACCGTTGGACTTACCTGAAATCATCCAAAGACTCCACAGCCTCAGCGCGTTTTCGCTCCACAGTT
```

TABLE 15-continued

Sequences of Exemplary Gene Targets

ACTCTCCAGGTGAAATCAATAGGGTGGCTGCATGCCTCAGGAAGCTTGGGGTTCCGCCCTTGCGAGCTTG

GAGACACCGGGCCCGGAGCGTTCGCGCCACACTCCTATCCCAGGGGGGAAAGCCGCTATATGCGGTAAG

TACCTCTTCAACTGGGCGGGTGAAAACCAAACTCAAACTCACTCCATTACCGTCCATGTCTCAGTTGGACT

TGTCCAACTGGTTCACGGGCGGTTACAGCGGGGGAGACATTTATCACAGCGTGTCTCATGCCCGGCCCCG

TTTGTTCCTCTGGTGCCTACTCCTACTTTCAGTAGGGGTAGGCATCTATCTCCTTCCCAACCGATAGACG

GNTGGGCAACCACTCCGGGTCTTTAGGCCCTATTTAAACACTCCAGGCCTTTAGGCCCCGT gi|23510419|ref|NM_000043.3| Homo sapiens tumor
necrosis factor receptor superfamily, member 6
(TNFRSF6), transcript variant 1, mRNA CCTACCCGCGCGCAGGCCAAGTTGCTGAATCAATGGAGCCCTCCCCAACCCGGGCGTTCCCCAGCGAGGC  (SEQ ID NO: 6692)

TTCCTTCCCATCCTCCTGACCACCGGGGCTTTTCGTGAGCTCGTCTCTGATCTCGCGCAAGAGTGACACA

CAGGTGTTCAAAGACGCTTCTGGGGAGTGAGGGAAGCGGTTTACGAGTGACTTGGCTGGAGCCTCAGGGG

CGGGCACTGGCACGGAACACACCCTGAGGCCAGCCCTGGCTGCCCAGGCGGAGCTGCCTCTTCTCCCGCG

GGTTGGTGGACCCGCTCAGTACGGAGTTGGGGAAGCTCTTTCACTTCGGAGGATTGCTCAACAACCATGC

TGGGCATCTGGACCCTCCTACCTCTGGTTCTTACGTCTGTTGCTAGATTATCGTCCAAAAGTGTTAATGC

CCAAGTGACTGACATCAACTCCAAGGGATTGGAATTGAGGAAGACTGTTACTACAGTTGAGACTCAGAAC

TTGGAAGGCCTGCATCATGATGGCCAATTCTGCCATAAGCCCTGTCCTCCAGGTGAAAGGAAAGCTAGGG

ACTGCACAGTCAATGGGGATGAACCAGACTGCGTGCCCTGCCAAGAAGGGAAGGAGTACACAGACAAAGC

CCATTTTTCTTCCAAATGCAGAAGATGTAGATTGTGTGATGAAGGACATGGCTTAGAAGTGGAAATAAAC

TGCACCCGGACCCAGAATACCAAGTGCAGATGTAAACCAAACTTTTTTTGTAACTCTACTGTATGTGAAAC

ACTGTGACCCTTGCACCAAATGTGAACATGGAATCATCAAGGAATGCACACTCACCAGCAACACCAAGTG

CAAAGAGGAAGGATCCAGATCTAACTTGGGGTGGCTTTGTCTTCTTCTTTTGCCAATTCCACTAATTGTT

TGGGTGAAGAGAAAGGAAGTACAGAAAACATGCAGAAAGCACAGAAAGGAAAACCAAGGTTCTCATGAAT

CTCCAACCTTAAATCCTGAAACAGTGGCAATAAATTTATCTGATGTTGACTTGAGTAAATATATCACCAC

TATTGCTGGAGTCATGACACTAAGTCAAGTTAAAGGCTTTGTTCGAAAGAATGGTGTCAATGAAGCCAAA

ATAGATGAGATCAAGAATGACAATGTCCAAGACACAGCAGAACAGAAAGTTCAACTGCTTCGTAATTGGC

ATCAACTTCATGGAAAGAAAGAAGCGTATGACACATTGATTAAAGATCTCAAAAAAGCCAATCTTTGTAC

TCTTGCAGAGAAAATTCAGACTATCATCCTCAAGGACATTACTAGTGACTCAGAAAATTCAAACTTCAGA

AATGAAATCCAAAGCTTGGTCTAGAGTGAAAAACAACAAATTCAGTTCTGAGTATATGCAATTAGTGTTT

GAAAAGATTCTTAATAGCTGGCTGTAAATACTGCTTGGTTTTTTACTGGGTACATTTTATCATTTATTAG

CGCTGAAGAGCCAACATATTTGTAGATTTTTAATATCTCATGATTCTGCCTCCAAGGATGTTTAAAATCT

AGTTGGGAAAACAAACTTCATCAAGAGTAAATGCAGTGGCATGCTAAGTACCCAAATAGGAGTGTATGCA

GAGGATGAAAGATTAAGATTATGCTCTGGCATCTAACATATGATTCTGTAGTATGAATGTAATCAGTGTA

TGTTAGTACAAATGTCTATCCACAGGCTAACCCCACTCTATGAATCAATAGAAGAAGCTATGACCTTTTG

CTGAAATATCAGTTACTGAACAGGCAGGCCACTTTGCCTCTAAATTACCTCTGATAATTCTAGAGATTTT

ACCATATTTCTAAACTTTGTTTATAACTCTGAGAAGATCATATTTATGTAAAGTATATGTATTTGAGTGC

AGAATTTAAATAAGGCTCTACCTCAAAGACCTTTGCACAGTTTATTGGTGTCATATTATACAATATTTCA

ATTGTGAATTCACATAGAAAACATTAAATTATAATGTTTGACTATTATATATGTGTATGCATTTTACTGG

CTCAAAACTACCTACTTCTTTCTCAGGCATCAAAAGCATTTTGAGCAGGAGAGTATTACTAGAGCTTTGC

CACCTCTCCATTTTTGCCTTGGTGCTCATCTTAATGGCCTAATGCACCCCCAAACATGGAAATATCACCA

TABLE 15-continued

Sequences of Exemplary Gene Targets

AAAAATACTTAATAGTCCACCAAAAGGCAAGACTGCCCTTAGAAATTCTAGCCTGGTTTGGAGATACTAA

CTGCTCTCAGAGAAAGTAGCTTTGTGACTGTCATGAACCCATGTTTGCAATCAAAGATGATAAAATAGA

TTCTTATTTTTCCCCCACCCCCGAAAATGTTCAATAATGTCCCATGTAAAACCTGCTACAAATGGCAGCT

TATACATAGCAATGGTAAAATCATCATCTGGATTTAGGAATTGCTCTTGTCATACCCCCAAGTTTCTAAG

ATTTAAGATTCTCCTTACTACTATCCTACGTTTAAATATCTTTGAAAGTTTGTATTAAATGTGAATTTTA

AGAAATAATATTTATATTTCTGTAAATGTAAACTGTGAAGATAGTTATAAACTGAAGCAGATACCTGGAA

CCACCTAAAGAACTTCCATTTATGGAGGATTTTTTTGCCCCTTGTGTTTGGAATTATAAAATATAGGTAA

AAGTACGTAATTAAATAATGTTTTTGGTAAAAAAAAAAAAAAAAAAAAAAAAAAAAAAAAAAAAAAAAA

AAAAAAAAAAAAAAAAAAAAAAAA gi|35910|emb|X12387.1|HSRCYP3 Human mRNA for
cytochrome P-450 (cyp3 locus)
GAATTCCCAAAGAGCAACACAGAGCTGAAAGGAAGACTCAGAGGAGAGAGATAAGTAAGGAAAGTAGTGA  (SEQ ID NO: 6693)

TGGCTCTCATCCCAGACTTGGCCATGGAAACCTGGCTTCTCCTGGCTGTCAGCCTGGTGCTCCTCTATCT

ATATGGAACCCATTCACATGGACTTTTTAAGAAGCTTGGAATTCCAGGGCCCACACCTCTGCCTTTTTTG

GGAAATATTTTGTCCTACCATAAGGGCTTTTGTATGTTTGACATGGAATGTCATAAAAAGTATGGAAAAG

TGTGGGCTTTTATGATGGTCAACAGCCTGTGCTGGCTATCACAGATCCTGACATGATCAAAACAGTGCT

AGTGAAAGAATGTTATTCTGTCTTCACAAACCGGAGGCCTTTTGGTCCAGTGGGATTTATGAAAAGTGCC

ATCTCTATAGCTGAGGATGAAGAATGGAAGAGATTACGATCATTGCTGTCTCCAACCTTCACCAGTGGAA

AACTCAAGGAGATGGTCCCTATCATTGCCCAGTATGGAGATGTGTTGGTGAGAAATCTGAGGCGGGAAGC

AGAGACAGGCAAGCCTGTCACCTTGAAAGACGTCTTTGGGGCCTACAGCATGGATGTGATCACTAGCACA

TCATTTGGAGTGAACATCGACTCTCTCAACAATCCACAAGACCCCTTTGTGGAAAACACCAAGAAGCTTT

TAAGATTTGATTTTTTGGATCCATTCTTTCTCTCAATAACAGTCTTTCCATTCCTCATCCCAATTCTTGA

AGTATTAAATATCTGTGTGTTTCCAAGAGAAGTTACAAATTTTTAAGAAAATCTGTAAAAAGGAATGAAA

GAAAGTCGCCTCGAAGATACACAAAAGCACCGAGTGGATTTCCTTCAGCTGATGATTGACTCTCAGAAATT

CAAAAGAAACTGAGTCCCACAAAGCTCTGTCCGATCTGGAGCTCGTGGCCCAATCAATTATCTTTATTTT

TGCTGGCTATGAAACCACGAGCAGTGTTCTCTCCTTCATTATGTATGAACTGGCCACTCACCCTGATGTC

CAGCAGAAACTGCAGGAGGAAATTGATGCAGTTTTACCCAATAAGGCACCACCCACCTATGATACTGTGC

TACAGATGGAGTATCTTGACATGGTGGTGAATGAACGCTCAGATTATTCCCAATTGCTATGAGACTTGA

GAGGGTCTGCAAAAAAGATGTTGAGATCAATGGGATGTTCATTCCCAAAGGGTGGGTGGTGATGATTCCA

AGCTATGCTCTTCACCGTGACCCAAAGTACTGGACAGAGCCTGAGAAGTTCCTCCCTGAAAGATTCAGCA

AGAAGAACAAGGACAACATAGATCCTTACATATACACACCCTTTGGAAGTGGACCCAGAAACTGCATTGG

CATGAGGTTTGCTCTCATGAACATGAAACTTGCTCTAATCAGAGTCCTTCAGAACTTCTCCTTCAAACCT

TGTAAAGAAACACAGATCCCCCTGAAATTAAGCTTAGGAGGACTTCTTCAACCAGAAAAACCCGTTGTTC

TAAAGGTTGAGTCAAGGGATGGCACCGTAAGTGGAGCCTGAATTTTCCTAAGGACTTCTGCTTTGCTCTT

CAAGAAATCTGTGCCTGAGAACACCAGAGACCTCAAATTACTTTGTGAATAGAACTCTGAAATGAAGATG

GGCTTCATCCAATGGACTGCATAAATAACCGGGGATTCTGTACATGCATTGAGCTCTCTCATTGTCTGTG

TAGAGTGTTATACTTGGGAATATAAAGGAGGTGACCAAATCAGTGTGAGGAGGTAGATTTGGCTCCTCTG

CTTCTCACGGGACTATTTCCACCACCCCCAGTTAGCACCATTAACTCCTCCTGAGCTCTGATAAGAGAAT

CAACATTTCTCAATAATTTCCTCCACAAATTATTAATGAAAATAAGAATTATTTTGATGGCTCTAACAAT

GACATTTATATCACATGTTTTCTCTGGAGTATTCTATAGTTTTATGTTAAATCAATAAAGACCACTTTAC

TABLE 15-continued

Sequences of Exemplary Gene Targets

AAAAGTATTATCAGATGCTTTCCTGCACATTAAGGAGAATCTATAGAACTGAATGAGAACCAACAAGTAA
ATATTTTGGTCATTGTAATCACTGTTGGCGTGGGGCCTTTGTCAGAACTAGAATTTGATTATTAACATA
GGTGAAAGTTAATCCACTGTGACTTTGCCCATTGTTTAGAAAGAATATTCATAGTTTAATTATGCCTTTT
TTGATCAGGCACATGGCTCACGCCTGTAATCCTAGCAGTTTGGGAGGCTGAGCCGGGTGGATCGCCTGAG
GTCAGGAGTTCAAGACAAGCCTGGCCTACATGGTGAAACCCCATCTCTACTAAAAATACACAAATTAGCT
AGGCATGGTGGACTCGCCTGTAATCTCACTACACAGGAGGCTGAGGCAGGAGAATCACTTGAACCTGGGA
GGCGGATGTTGAAGTGAGCTGAGATTGCACCACTGCACTCCAGTCTGGGTGAGAGTGAGACTCAGTCTTA
AAAAAATATGCCTTTTTGAAGCACGTACATTTTGTAACAAAGAACTGAAGCTCTTATTATATTATTAGTT
TTGATTTAATGTTTTCAGCCCATCTCCTTTCATATTTCTGGGAGACAGAAAACATGTTTCCCTACACCTC
TTGCTTCCATCCTCAACACCCAACTGTCTCGATGCAATGAACACTTAATAAAAAACAGTCGATTGGTCAA
AAAAAAAAAAAAAAAAAAAAAAGAATTC gi|339549|gb|M19154.1|HUMTGFB2A Human transforming growth
factor-beta-2 mRNA, complete cds
GCCCCTCCCGTCAGTTCGCCAGCTGCCAGCCCCGGGACCTTTTCATCTCTTCCCTTTTGGCCGGAGGAGC    (SEQ ID NO: 6694)
CGAGTTCAGATCCGCCACTCCGCACCCGAGACTGACACACTGAACTCCACTTCCTCCTCTTAAATTTATT
TCTACTTAATAGCCACTCGTCTCTTTTTTTCCCCATCTCATTGCTCCAAGAATTTTTTCTTCTTACTCG
CCAAAGTCAGGGTTCCCTCTGCCCGTCCCGTATTAATATTTCCACTTTTGGAACTACTGGCCTTTTCTTT
TTAAAGGAATTCAAGCAGGATACGTTTTTCTGTTGGGCATTGACTAGATTGTTTGCAAAAGTTTCGCATC
AAAAACAACAACAACAAAAAACCAAACAACTCTCCTTGATCTATACTTTGAGAATTGTTGATTTCTTTTT
TTTATTCTGACTTTTAAAAACAACTTTTTTTTTCCACTTTTTTAAAAAATGCACTACTGTGTGCTGAGCGC
TTTTCTGATCCTGCATCTGGTCACGGTCGCGCTCAGCCTGTCTACCTGCAGCACACTCGATATGGACCAG
TTCATGCGCAAGAGGATCGAGGCGATCCGCGGGCAGATCCTGAGCAAGCTGAAGCTCACCAGTCCCCCAG
AAGACTATCCTGAGCCCGAGGAAGTCCCCCCGGAGGTGATTTCCATCTACAACAGCACCAGGGACTTGCT
CCAGGAGAAGGCGAGCCGGAGGGCGGCCGCCTGCGAGCGCGAGAGGAGCGACGAAGAGTACTACGCCAAG
GAGGTTTACAAAATAGACATGCCGCCCTTCTTCCCCTCCGAAACTGTCTGCCCAGTTGTTACAACACCCT
CTGGCTCAGTGGGCAGCTTGTGCTCCAGACAGTCCCAGGTGCTCTGTGGGTACCTTGATGCCATCCCGCC
CACTTTCTACAGACCCTACTTCAGAATTGTTCGATTTGACGTCTCAGCAATGGAGAAGAATGCTTCCAAT
TTGGTGAAAGCAGAGTTCAGAGTCTTTCGTTTGCAGAACCCAAAAGCCAGAGTGCCTGAACAACGGATTG
AGCTATATCAGATTCTCAAGTCCAAGATTTAACATCTCCAACCCAGCGCTACATCGACAGCAAAGTTGT
GAAAACAAGAGCAGAAGGCGAATGGCTCTCCTTCGATGTAACTGATGCTGTTCATGAATGGCTTCACCAT
AAAGACAGGAACCTGGGATTTAAAATAAGCTTACACTGTCCCTGCTGCACTTTTGTACCATCTAATAATT
ACATCATCCCAAATAAAAGTGAAGAACTAGAAGCAAGATTTGCAGGTATTGATGGCACCTCCACACATATAC
CAGTGGTGATCAGAAAACTATAAAGTCCACTAGGAAAAAAAACAGTGGGAAGACCCCACATCTCCTGCTA
ATGTTATTGCCCTCCTACAGACTTGAGTCACAACAGACCAACCGGCGGAAGAAGCGTGCTTTGGATGCGG
CCTATTGCTTTAGAAATGTGCAGGATAATTGCTGCCTACGTCCACTTTACATTGATTTCAAGAGGGATCT
AGGGTGGAAATGGATACACGAACCCAAAGGGTACAATGCCAACTTCTGTGCTGGAGCATGCCCGTATTTA
TGGAGTTCAGACACTCAGCACAGCAGGGTCCTGAGCTTATATAATACCATAAATCCAGAAGCATCTGCTT
CTCCTTGCTGCGTGTCCCAAGATTTAGAACCTCTAACCATTCTCTACTACATTGGCAAAACACCCAAGAT
TGAACAGCTTTCTAATATGATTGTAAAGTCTTGCAAATGCACTAAAATTCTTGGAAAAGTGGCAAGACC
AAAATGACAATGATGATGATAATGATGATGACGACGACAACGATGATGCTTGTAACAAGAAAACATAAGA TABLE 15-continued Sequences of Exemplary Gene Targets

GAGCCTTGGTTCATCAGTGTTAAAAAATTTTTGAAAAGGCGGTACTAGTTCAGACACTTTGGAAGTTTGT

GTTCTGTTTGTTAAAACTGGCATCTGACACAAAAAAAGTTGAAGGCCTTATTCTACATTTCACCTACTTT

GTAAGTGAGAGAGACAAGAAGCAAATTTTTTTAAAGAAAAAAATAAACACTGGAAGAATTTATTAGTGT

TAATTATGTGAACAACGACAACAACAACAACAACAACAAACAGGAAAATCCCATTAAGTGGAGTTGCTGT

ACGTACCGTTCCTATCCCGCGCCTCACTTGATTTTTCTGTATTGCTATGCAATAGGCACCCTTCCCATTC

TTACTCTTAGAGTTAACAGTGAGTTATTTATTGTGTGTTACTATATAATGAACGTTTCATTGCCCTTGGA

AAATAAAACAGGTGTATAAAGTGGAGACCAAATACTTTGCCAGAAACTCATGGATGGCTTAAGGAACTTG

AACTCAAACGAGCCAGAAAAAAGAGGTCATATTAATGGGATGAAAACCCAAGTGAGTTATTATATGACC

GAGAAAGTCTGCATTAAGATAAAGACCCTGAAAACACATGTTATGTATCAGCTGCCTAAGGAAGCTTCTT

GTAAGGTCCAAAAACTAAAAAGACTGTTAATAAAAGAAACTTTCAGTCAG gi|186624|gb|J04111.1|HUMJUNA Human c-jun proto oncogene
(JUN), complete cds, clone hCJ-1
CCCGGGGAGGGGACCGGGGAACAGAGGGCCGAGAGGCGTGCGGCAGGGGGGAGGGTAGGAGAAAGAAGGG    (SEQ ID NO: 6695)

CCCGACTGTAGGAGGGCAGCGGAGCATTACCTCATCCCGTGAGCCTCCGCGGGCCCAGAGAAGAATCTTC

TAGGGTGGAGTCTCCATGGTGACGGGCGGGCCCGCCCCCCTGAGAGCGACGCGAGCCAATGGGAAGGCCT

TGGGGTGACATCATGGGCTATTTTTAGGGGTTGACTGGTAGCAGATAAGTGTTGAGCTCGGGCTGGATAA

GGGCTCAGAGTTGCACTGAGTGTGGCTGAAGCAGCGAGGCGGGAGTGGAGGTGCGCGGAGTCAGGCAGAC

AGACAGACACGCCAGCCAGCCAGGTCGGCAGTATAGTCCGAACTGCAAATCTTATTTTCTTTTCACCTT

CTCTCTAACTGCCCAGAGCTAGCGCCTGTGGCTCCCGGGCTGGTGGTTCGGGAGTGTCCAGAGAGCCTTG

TCTCCAGCCGGCCCCGGGAGGAGAGCCCTGCTGCCCAGGCGCTGTTGACAGCGGCGGAAAGCAGCGGTAC

CCCACGCGCCCGCCGGGGACGTCGGCGAGCGGCTGCAGCAGCAAAGAACTTTCCCGGCGGGGAGGACCG

GAGACAAGTGGCAGAGTCCCGGAGCGAACTTTTGCAAGCCTTTCCTGCGTCTTAGGCTTCTCCACGGCGG

TAAAGACCAGAAGGCGGCGGAGAGCCACGCAAGAGAAGAAGGACGTGCGCTCAGCTTCGCTCGCACCGGT

TGTTGAACTTGGGCGAGCGCGAGCCGCGGCTGCCGGGCGCCCCCTCCCCTAGCAGCGGAGGAGGGGACA

AGTCGTCGGAGTCCGGGCGGCCAAGACCCGCCGCCGGCCGGCCACTGCAGGGTCCGCACTGATCCGCTCC

GCGGGGAGAGCCGCTGCTCTGGGAAGTGAGTTCGCCTGCGGACTCCGAGGAACCGCTGCGCCCGAAGAGC

GCTCAGTGAGTGACCGCGACTTTTCAAAGCCGGGTAGCGCGCGCGAGTCGACAAGTAAGAGTGCGGGAGG

CATCTTAATTAACCCTGCGCTCCCTGGAGCGAGCTGGTGAGGAGGGCGCAGCGGGGACGACAGCCAGCGG

GTGCGTGCGCTCTTAGAGAACTTTCCCTGTCAAAGGCTCCGGGGGCGCGGGTGTCCCCCGCTTGCCAG

AGCCCTGTTGCGGCCCCGAAACTTGTGCGCGCACGCCAAACTAACCTCACGTGAAGTGACGGACTGTTCT

ATGACTGCAAAGATGGAAACGACCTTCTATGACGATGCCCTCAACGCCTCGTTCCTCCCGTCCGAGAGCG

GACCTTATGGCTACAGTACCCCAAAGATCCTGAAACAGAGCATGACCCTGAACCTGGCCGACCCAGTGGG

GAGCCTGAAGCCGCACCTCCGCGCCAAGAACTCGGACCTCCTCACCTCGCCCGACGTGGGGCTGCTCAAG

CTGGCGTCGCCCGAGCTGGAGCGCCTGATAATCCAGTCCAGCAACGGGCACATCACCACCACGCCGACCC

CCACCCAGTTCCTGTGCCCCAAGAACGTGACAGATGAGCAGGAGGGGTTCGCCGAGGGCTTCGTGCGCGC

CCTGGCCGAACTGCACAGCCAGAACACGCTGCCCAGCGTCACGTCGGCGGCGCAGCCGGTCAACGGGGCA

GGCATGGTGGCTCCCGCGGTAGCCTCGGTGGCAGGGGGCAGCGGCAGCGGCGGCTTCAGCGCCAGCCTGC

ACAGCGAGCCGCCGGTCTACGCAAACCTCAGCAACTTCAACCCAGGCGCGCTGAGCAGCGGCGGCGGGGC

GCCCTCCTACGGCGCGGCCGGCCTGGCCTTTCCCGCGCAACCCCAGCAGCAGCAGCAGCCGCCGCACCAC

CTGCCCCAGCAGATGCCCGTGCAGCACCCCGCGGCTGCAGGCCCTGAAGGAGGAGCCTCAGACAGTGCCCG

TABLE 15-continued

Sequences of Exemplary Gene Targets

AGATGCCCGGCGAGACACCGCCCCTGTCCCCCATCGACATGGAGTCCCAGGAGCGGATCAAGGCGGAGAG

GAAGCGCATGAGGAACCGCATCGCTGCCTCCAAGTGCCGAAAAAGGAAGCTGGAGAGAATCGCCCGGCTG

GAGGAAAAAGTGAAAACCTTGAAAGCTCAGAACTCGGAGCTGGCGTCCACGGCCAACATGCTCAGGGAAC

GTTGCAAACATTTTGAAGAGAGACCGTCGGGGGCTGAGGGGCAACGAAGAAAAAAATAACACAGAGAGA

CAGACTTGAGAACTTGACAAGTTGCGACGGAGAGAAAAAAGAAGTGTCCGAGAACTAAAGCCAAGGGTAT

CCAAGTTGGACTGGGTTCGGTCTGACGGCGCCCCCAGTGTGCACGAGTGGGAAGGACTTGGTCGCGCCCT

CCCTTGGCGTGGAGCCAGGGAGCGGCCGCCTGCGGGCTGCCCCGCTTTGCGGACGGGCTGTCCCCGCGCG

AACGGAACGTTGGACTTTCGTTAACATTGACCAAGAACTGCATGGACCTAACATTCGATCTCATTCAGTA

TTAAAGGGGGGAGGGGAGGGGGTTACAAACTGCAATAGAGACTGTAGATTGCTTCTGTAGTACTCCTTA

AGAACACAAAGCGGGGGAGGGTTGGGGAGGGGCGGCAGGAGGGAGGTTTGTGAGAGCGAGGCTGAGCCT

ACAGATGAACTCTTTCTGGCCTGCTTTCGTTAACTGTGTATGTACATATATATATTTTTAATTTGATTA

AAGCTGATTACTGTCAATAAACAGCTTCATGCCTTTGTAAGTTATTTCTTGTTTGTTTGTTTGGGTATCC

TGCCCAGTGTTGTTTGTAATAAGAGATTTGGAGCACTCTGAGTTTACCATTTGTAAATAAGTATATAAT

TTTTTTATGTTTTGTTTCTGAAAATTCCAGAAAGGATATTTAAGAAAATACAATAAACTATTGGAAAGTA

CTCCCCTAACCTCTTTTCTGCATCATCTGTAGATCCTAGTCTATCTAGGTGGAGTTGAAAGAGTTAAGAA

TGCTCGATAAAATCACTCTCAGTGCTTCTTACTATTAAGCAGTAAAAACTGTTCTCTATTAGACTTAGAA

ATAAATGTACCTGATGTACCTGATGCTATGTCAGGCTTCATACTCCACGCTCCCCAGCGTATCTATATG

GAATTGCTTACCAAAGGCTAGTGCGATGTTTCAGGAGGCTGGAGGAAGGGGGTTGCAGTGGAGAGGGAC

AGCCCACTGAGAAGTCAAACATTTCAAAGTTTGGATTGCATCAAGTGGCATGTGCTGTGACCATTTATAA

TGTTAGAAATTTTACAATAGGTGCTTATTCTCAAAGCAGGAATTGGTGGCAGATTTTACAAAGATGTAT

CCTTCCAATTTGGAATCTTCTCTTTGACAATTCCTAGATAAAAGATGGCCTTTGTCTTATGAATATTTA

TAACAGCATTCTGTCACAATAAATGTATTCAAATACCAATAACAGATCTTGAATTGCTTCCCTTTAGTAC

TTTTTTGTTCCCAAGTTATATACTGAAGTTTTTATTTTTAGTTGCTGAGGTT gi|179982|gb|M57729.1|HUMCCC5 Human complement  
component C5 mRNA, complete cds  
CTACCTCCAACCATGGGCCTTTTGGGAATACTTTGTTTTTAATCTTCCTGGGGAAAACCTGGGGACAGG  (SEQ ID NO: 6696)

AGCAAACATATGTCATTTCAGCACCAAAAATATTCCGTGTTGGAGCATCTGAAAATATTGTGATTCAAGT

TTATGGATACACTGAAGCATTTGATGCAACAATCTCTATTAAAAGTTATCCTGATAAAAATTTAGTTAC

TCCTCAGGCCATGTTCATTTATCCTCAGAGAATAAATTCCAAAACTCTGCAATCTTAACAATACAACCAA

AACAATTGCCTGGAGGACAAAACCCAGTTTCTTATGTGTATTTGGAAGTTGTATCAAAGCATTTTTCAAA

ATCAAAAAGAATGCCAAATAACCTATGACAATGGATTTCTCTTCATTCATACAGACAAACCTGTTTATACT

CCAGACCAGTCAGTAAAAGTTAGAGTTTATTCGTTGAATGACGACTTGAAGCCAGCCAAAAGAGAAACTG

TCTTAACCTTCATAGATCCTGAAGGATCAGAAGTTGACATGGTAGAAGAAATTGATCATATTGGAATTAT

CTCTTTTCCTGACTTCAAGATTCCGTCTAATCCTAGATATGGTATGTGGACGATCAAGGCTAAATATAAA

GAGGACTTTCAACAACTGGAACCGCATATTTTGAAGTTAAAGAATATGTCTTGCCACATTTTCTGTCT

CAATCGAGCCAGAATATAATTTCATTGGTTACAAGAACTTTAAGAATTTTGAAATTACTATAAAAGCAAG

ATATTTTTATAATAAAGTAGTCACTGAGGCTGACGTTTATATCACATTTGGAATAAGAGAAGACTTAAAA

GATGATCAAAAAGAAATGATGCAAACAGCAATGCAAAACACAATGTTGATAAATGGAATTGCTCAAGTCA

TTATATTGCTGTAACAGTCATAGAGTCTACAGGTGGATTTTCTGAAGAGGCAGAAATACCTGGCATCAAA

TATGTCCTCTCTCCCTACAAACTGAATTTGGTTGCTACTCCTCTTTTCCTGAAGCCTGGGATTCCATATC

TABLE 15-continued

Sequences of Exemplary Gene Targets

CCATCAAGGTGCAGGTTAAGATTCGCTTGACCAGTTGGTAGGAGGAGTCCCAGTAATACTGAATGCACA

AACAATTGATGTAAACCAAGAGACATCTGACTTGGATCCAAGCAAAAGTGTAACACGTGTTGATGATGGA

GTAGCTTCCTTTGTGCTTAATCTCCCATCTGGAGTGACGGTGCTGGAGTTTAATGTCAAACTGATGCTC

CAGATCTTCCAGAAGAAATCAGGCCAGGGAAGGTTACCGAGCAATAGCATACTCATCTCTCAGCCAAAG

TTACCTTTATATTGATTGGACTGATAACCATAAGGCTTTGCTAGTGGGAGACATCTGAATATTATTGTT

ACCCCCAAAAGCCCATATATTGACAAAATAACTCACTATAATTACTTGATTTTATCCAAGGGCAAAATTA

TCCATTTTGGCACGAGGGAGAAATTTTCAGATGCATCTTATCAAAGTATAACATTCCAGTAACACAGAA

CATGGTTCCTTCATCCCGACTTCTGGTCTATTATATCGTCACAGGAGACAGACAGCAGAATTAGTGTCT

GATTCAGTCTGGTTAAATATTGAAGAAAAATGTGGCAACCAGCTCCAGGTTCATCTGTCTCCTGATGCAG

ATGCATATTCTCCAGGCCAAACTGTGTCTCTTAATATGGCAAACTGGAATGGATTCCTGGGTGGCATTAGC

AGCAGTGGACAGTGCTGTGTATGGAGTCCAAAGAGGAGCCAAAAAGCCCTTGGAAAGAGTATTTCAATTC

TTAGAGAAGAGTGATCTGGGCTGTGGGGCAGGTGGTGGCCTCAACAATGCCAATGTGTTCCACCTAGCTG

GACTTACCTTCCTCACTAATGCAAATGCAGATGACTCCCAAGAAAATGATGAACCTTGTAAAGAAATTCT

CAGGCCAAGAAGAACGCTGCAAAAGAAGATAGAAGAAATAGCTGCTAAATATAAACATTCAGTAGTGAAG

AAATGTTGTTACGATGGAGCCTGCGTTAATAATGATGAAACCTGTGAGCAGCGAGCTGCACGGATTAGTT

TAGGGCGAAGATGCATCAAAGCTTTCACTGAATGTTGTGTCGTCGCAAGCCAGCTCCGTGCTAATATCTC

TCATAAAGACATGCAATTGGGAAGGCTACACATGAAGACCCTGTTACCAGTAAGCAAGCCAGAAATTCGG

AGTTATTTTCCAGAAAGCTGGTTGTGGGAAGTTCATCTTGTTCCCAGAAGAAAACAGTTGCAGTTTGCCC

TACCTGATTCTCTAACCACCTGGGAAATTCAAGGCATTGGCATTTCAAACACTGGTATATGTGTTGCTGA

TACTGTCAAGGCAAAGGTGTTCAAAGATGTCTTCCTGGAAATGAATATACCATATTCTGTTGTACGAGGA

GAACAGATCCAATTGAAAGGAACTGTTTACAACTATAGGACTTCTGGGATGCAGTTCTGTGTTAAAATGT

CTGCTGTGGAGGGAATCTGCACTTCGGAAAGCCCAGTCATTGATCATCAGGGCACAAAGTCCTCCAAATG

TGTGCGCCAGAAAGTAGAGGGCTCCTCCAGTCACTTGGTGACATTCACTGTGCTTCCTCTGGAAATTGGC

CTTCACAACATCAATTTTTCACTGGAGACTTGGTTTGGAAAAGAAATCTTAGTAAAAACATTACGAGTGG

TGCCAGAAGGTGTCAAAAGGGAAAGCTATTCTGGTGTTACTTTGGATCCTAGGGGTATTTATGGTACCAT

TAGCAGACGAAAGGAGTTCCCATACAGGATACCCTTAGATTTGGTCCCCAAAACAGAAATCAAAAGGATT

TTGAGTGTAAAAGGACTGCTTGTAGGTGAGATCTTGTCTGCAGTTCTAAGTCAGGAAGGCATCAATATCC

TAACCCACCTCCCCAAAGGGAGTGCAGAGGCGGAGCTGATGAGCGTTGTCCCAGTATTCTATGTTTTTCA

CTACCTGGAAACAGGAAATCATTGGAACATTTTTCATTCTGACCCATTAATTGAAAAGCAGAAACTGAAG

AAAAAATTAAAAGAAGGGATGTTGAGCATTATGTCCTACAGAAATGCTGACTACTCTTACAGTGTGTGGA

AGGGTGGAAGTGCTAGCACTTGGTTAACAGCTTTTGCTTTAAGAGTACTTGGACAAGTAAATAAATACGT

AGAGCAGAACCAAAATTCAATTTGTAATTCTTTATTGTGGCTAGTTGAGAATTATCAATTAGATAATGGA

TCTTTCAAGGAAAATTCACAGTATCAACCAATAAAATTACAGGGTACCTTGCCTGTTGAAGCCCGAGAGA

ACAGCTTATATCTTACAGCCTTTACTGTGATTGGAATTAGAAAGGCTTTCGATATATGCCCCCTGGTGAA

AATCGACACAGCTCTAATTAAAGCTGACAACTTTCTGCTTGAAAATACACTGCCAGCCCAGAGCACCTTT

ACATTGGCCATTTCTGCGTATGCTCTTTCCCTGGGAGATAAAACTCACCCACAGTTTCGTTCAATTGTTT

CAGCTTTGAAGAGAGAAGCTTTGGTTAAAGGTAATCCACCCATTTATCGTTTTTGGAAAGACAATCTTCA

GCATAAAGACAGCTCTGTACCTAACACTGGTACGGCACGTATGGTAGAAACAACTGCCTATGCTTTACTC

ACCAGTCTGAACTTGAAAGATATAAATTATGTTAACCCAGTCATCAAATGGCTATCAGAAGAGCAGAGGT

TABLE 15-continued

Sequences of Exemplary Gene Targets

ATGGAGGTGGCTTTTATTCAACCCAGGACACCATCAATGCCATTGAGGGCCTGACGGAATATTCACTCCT
GGTTAAACAACTCCGCTTGAGTATGGACATCGATGTTTCTTACAAGCATAAAGGTGCCTTACATAATTAT
AAAATGACAGACAAGAATTTCCTTGGGAGGCCAGTAGAGGTGCTTCTCAATGATGACCTCATTGTCAGTA
CAGGATTTGGCAGTGGCTTGGCTACAGTACATGTAACAACTGTAGTTCACAAAACCAGTACCTCTGAGGA
AGTTTGCAGCTTTTATTTGAAAATCGATACTCAGGATATTGAAGCATCCCACTACAGAGGCTACGGAAAC
TCTGATTACAAACGCATAGTAGCATGTGCCAGCTACAAGCCCAGCAGGGAAGAATCATCATCTGGATCCT
CTCATGCGGTGATGGACATCTCCTTGCCTACTGGAATCAGTGCAAATGAAGAAGACTTAAAAGCCCTTGT
GGAAGGGGTGGATCAACTATTCACTGATTACCAAATCAAAGATGGACATGTTATTCTGCAACTGAATTCG
ATTCCCTCCAGTGATTTCCTTTGTGTACGATTCCGGATATTTGAACTCTTTGAAGTTGGGTTTCTCAGTC
CTGCCACTTTCACAGTTTACGAATACCACAGACCAGATAAACAGTGTACCATGTTTTATAGCACTTCCAA
TATCAAAATTCAGAAAGTCTGTGAAGGAGCCGCGTGCAAGTGTGTAGAAGCTGATTGTGGGCAAATGCAG
GAAGAATTGGATCTGACAATCTCTGCAGAGACAAGAAAACAAACAGCATGTAAACCAGAGATTGCATATG
CTTATAAAGTTAGCATCACATCCATCACTGTAGAAAATGTTTTTGTCAAGTACAAGGCAACCCTTCTGGA
TATCTACAAAACTGGGGAAGCTGTTGCTGAGAAAGACTCTGAGATTACCTTCATTAAAAAGGTAACCTGT
ACTAACGCTGAGCTGGTAAAAGGAAGACAGTACTTAATTATGGGTAAAGAAGCCCTCCAGATAAAATACA
ATTTCAGTTTCAGGTACATCTACCCTTTAGATTCCTTGACCTGGATTGAATACTGGCCTAGAGACACAAC
ATGTTCATCGTGTCAAGCATTTTTAGCTAATTTAGATGAATTTGCCGAAGATATCTTTTTAAATGGATGC
TAAAATTCCTGAAGTTCAGCTGCATACAGTTTGCACTTATGGACTCCTGTTGTTGAAGTTCGTTTTTTTG
TTTTCTTCTTTTTTTAAACATTCATAGCTGGTCTTATTTGTAAAGCTCACTTTACTTAGAATTAGTGGCA
CTTGCTTTTATTAGAGAATGATTTCAAATGCTGTAACTTTCTGAAATAACATGGCCTTGGAGGGCATGAA
GACAGATACTCCTCCAAGGTTATTGGACACCGGAAACAATAAATTGGAACACCTCCTCAAACCTACCACT
CAGGAATGTTTGCTGGGCCGAAAGAACAGTCCATTGAAAGGGAGTATTACAAAACATGGCCTTTGCTT
GAAAGAAAATACCAAGGAACAGGAAACTGATCATTAAAGCCTGAGTTTGCTTTC gi|189944|gb|L05144.1|HUMPHOCAR *Homo sapiens* (clone
lamda-hPEC-3) phosphoenolpyruvate carboxykinase (PCK1)
mRNA, complete cds
TGGGAACACAAACTTGCTGGCGGGAAGAGCCCGGAAAGAAACCTGTGGATCTCCCTTCGAGATCATCCAA      (SEQ ID NO: 6697)
AGAGAAGAAAGGTGACCTCACATTCGTGCCCCTTAGCAGCACTCTGCAGAAATGCCTCCTCAGCTGCAAA
ACGGCCTGAACCTCTCGGCCAAAGTTGTCCAGGGAAGCCTGGACAGCCTGCCCCAGGCAGTGAGGGAGTT
TCTCGAGAATAACGCTGAGCTGTGTCAGCCTGATCACATCCACATCTGTGACGGCTCTGAGGAGGAGAAT
GGGCGGCTTCTGGGCCAGATGGAGGAAGAGGGGCATCCTCAGGCGGCTGAAGAAGTATGACAACTGCTGGT
TGGCTCTCACTGACCCCAGGGATGTGGCCAGGATCGAAAGCAAGACGGTTATCGTCACCCAAGAGCAAAG
AGACACAGTGCCCATCCCCAAAACAGGCCTCAGCCAGCTCGGTCGCTGGATGTCAGAGGAGGATTTTGAG
AAAGCGTTCAATGCCAGGTTCCCAGGGTGCATGAAAGGTCGCACCATGTACGTCATCCCATTCAGCATGG
GGCCGCTGGGCTCACCTCTGTCGAAGATCGGCATCGAGCTGACGGATTCGCCCTACGTGGTGGCCAGCAT
GCGGATCATGACGCGGATGGGCACGCCCGTCCTGGAAGCACTGGGCGATGGGGAGTTTGTCAAATGCCTC
CATTCTGTGGGGTGCCCTCTGCCTTTACAAAAGCCTTTGGTCAACAACTGGCCCTGCAACCCGGAGCTGA
CGCTCATCGCCCACCTGCCTGACCGCAGAGAGATCATCTCCTTTGGCAGTGGGTACGGCGGGAACTCGCT
GCTCGGGAAGAAGTGCTTTGCTCTCAGGATGGCCAGCCGGCTGGCAGAGGAGGAAGGGTGGCTGGCAGAG
CACATGCTGATTCTGGGTATAACCAACCCTGAGGGTGAGAAGAAGTACCTGGCGGCCGCATTTCCCAGCG

TABLE 15-continued

Sequences of Exemplary Gene Targets

CCTGCGGGAAGACCAACCTGGCCATGATGAACCCCAGCCTCCCCGGGTGGAAGGTTGAGTGCGTCGGGGA

TGACATTGCCTGGATGAAGTTTGACGCACAAGGTCATTTAAGGGCCATCAACCCAGAAAATGGCTTTTTC

GGTGTCGCTCCTGGGACTTCAGTGAAGACCAACCCCAATGCCATCAAGACCATCCAGAAGAACACAATCT

TTACCAATGTGGCCGAGACCAGCGACGGGGCGTTTACTGGGAAGGCATTGATGAGCCGCTAGCTTCAGG

CGTCACCATCACGTCCTGGAAGAATAAGGAGTGGAGCTCAGAGGATGGGGAACCTTGTGCCCACCCCAAC

TCGAGGTTCTGCACCCCTGCCAGCCAGTGCCCCATCATTGATGCTGCCTGGGAGTCTCCGGAAGGTGTTC

CCATTGAAGGCATTATCTTTGGAGGCCGTAGACCTGCTGGTGTCCCTCTAGTCTATGAAGCTCTCAGCTG

GCAACATGGAGTCTTTGTGGGGGCGGCCATGAGATCAGAGGCCACAGCGGCTGCAGAACATAAAGGCAAA

ATCATCATGCATGACCCCTTTGCCATGCGGCCCTTCTTTGGCTACAACTTCGGCAAATACCTGGCCCACT

GGCTTAGCATGGCCCAGCACCCAGCAGCCAAACTGCCCAAGATCTTCCATGTCAACTGGTTCCGGAAGGA

CAAGGAAGGCAAATTCCTCTGGCCAGGCTTTGGAGAGAACTCCAGGGTGCTGGAGTGGATGTTCAACCGG

ATCGATGGAAAAGCCAGCACCAACGTCACGCCCATAGGCTACATCCCCAAGGAGGATGCCCTGAACCTGA

AAGGCCTGGGGCACATCAACATGATGGAGCTTTTCAGCATCTCCAAGGAATTCTGGGACAAGGAGGTGGA

AGACATCGAGAAGTATCTGGTGGATCAAGTCAATGCCGACCTCCCCTGTGAAATCGAGAGAGAGATCCTT

GCCTTGAAGCAAAGAATAAGCCAGATGTAATCAGGGCCTGAGAATAAGCCAGATGTAATCAGGGCCTGAG

TGCTTTACCTTTAAAATCATTAAATTAAAATCCATAAGGTGCAGTAGGAGCAAGAGAGGGCAAGTGTTCC

CAAATTGACGCCACCTAATAATCATCACCACACCGGGAGCAGATCTGAAGGCACACTTTGATTTTTTTAA

GGATAAGAACCACAGAACACTGGGTAGTAGCTAATGAAATTGAGAAGGGAAATCTTAGCATGCCTCCAAA

AATTCACATCCAATGCATACTTTGTTCAAATTTAAGGTTACTCAGGCATTGATCTTTTCAGTGTTTTTTC

ACTTAGCTATGTGGATTAGCTAGAATGCACACCAAAAGATACTTGAGCTGTATATATATATGTGTGTGT

GTGTGTGTGTGTGTGTGTGCATGTATGTGCACATGTGTCTGTGATATTTGGTATGTGTATTTGT

ATGTACTGTTATTCAAAATATATTTAATACCTTTGGAAAATCTTGGGCAAGATGACCTACTAGTTTTCCT

TGAAAAAAGTTGCTTTGTTATTAATATTGTGCTTAAATTATTTTTATACACCATTGTTCCTTACCTTTA

CATAATTGCAATATTTCCCCCTTACTACTTCTTGGAAAAAAATTAGAAAATGAAGTTTATAGAAAAG

```
gi|6679892|ref|NM_008061.1| Mus musculus
glucose-6-phosphatase, catalytic (G6pc), mRNA
```
AGCAGAGGGATCGGGGCCAACCGGGCTTGGACTCACTGCACGGGCTCTGCTGGCAGCTTCCTGAGGTACC    (SEQ ID NO: 6698)

AAGGGAGGAAGGATGGAGGAAGGAATGAACATTCTCCATGACTTTGGGATCCAGTCGACTCGCTATCTCC

AAGTGAATTACCAAGACTCCCAGGACTGGTTCATCCTTGTGTCTGTGATTGCTGACCTGAGGAACGCCTT

CTATGTCCTCTTTCCCATCTGGTTCCATCTTAAAGAGACTGTGGGCATCAATCTCCTCTGGGTGGCAGTG

GTCGGAGACTGGTTCAACCTCGTCTTCAAGTGGATTCTGTTTGGACAACGCCCGTATTGGTGGGTCCTGG

ACACCGACTACTACAGCAACAGCTCCGTGCCTATAATAAAGCAGTTCCCTGTCACCTGTGAGACCGGACC

AGGAAGTCCCTCTGGCCATGCCATGGGCGCAGCAGGTGTATACTATGTTATGGTCACTTCTACTCTTGCT

ATCTTTCGAGGAAAGAAAAGCCAACGTATGGATTCCGGTGTTTGAACGTCATCTTGTGGTTGGGATTCT

GGGCTGTGCAGCTGAACGTCTGTCTGTCCCGGATCTACCTTGCTGCTCACTTTCCCCACCAGGTCGTGGC

TGGAGTCTTGTCAGGCATTGCTGTGGCTGAAACTTTCAGCCACATCCGGGGCATCTACAATGCCAGCCTC

CGGAAGTATTGTCTCATCACCATCTTCTTGTTTGGTTTCGCGCTTGGATTCTACCTGCTACTAAAAGGGC

TAGGGGTGGACCTCCTGTGGACTTTGGAGAAAGCCAAGAGATGGTGTGAGCGGCCAGAATGGGTCCACCT

TGACACTACACCCTTTGCCAGCCTCTTCAAAAACCTGGGAACCCTCTTGGGGTTGGGGCTGGCCCTCAAC

TCCAGCATGTACCGGAAGAGCTGCAAGGGAGAACTCAGCAAGTCGTTCCCATTCCGCTTCGCCTGCATTG

TABLE 15-continued

Sequences of Exemplary Gene Targets

TGGCTTCCTTGGTCCTCCTGCATCTCTTTGACTCTCTGAAGCCCCCATCCCAGGTTGAGTTGATCTTCTA

CATCTTGTCTTTCTGCAAGAGCGCAACAGTTCCCTTTGCATCTGTCAGTCTTATCCCATACTGCCTAGCC

CGGATCCTGGGACAGACACACAAGAAGTCTTTGTAAGGCATGCAGAGTCTTTGGTATTTAAAGTCAACCG

CCATGCAAAGGACTAGGAACAACTAAAGCCTCTGAAACCCATTGTGAGGCCAGAGGTGTTGACATCGGCC

CTGGTAGCCCTGTCTTTCTTTGCTATCTTAACCAAAAGGTGAATTTTTACAAAGCTTACAGGGCTGTTTG

AGGAAAGTGTGAATGCTGGAAACTGAGTCATTCTGGATGGTTCCCTGAAGATTCGCTTACCAGCCTCCTG

TCAGATACAGAAGAGCAAGCCCAGGCTAGAGATCCCAACTGAGAATGCTCTTGCGGTGCAGAATCTTCCG

GCTGGGAAAGGAAAAGAGCACCATGCATTTGCCAGGAAGAGAAAGAAGGATCGGGAGGAGGGAGAGTGT

TTTATGTATCGAGCAAACCAGATGCAATCTATGTCTAACCGGCTTCAGTTGTGTCTGCGTCTTTAGATAC

GACACACTCAATAATAATAATAGACCAACTAGTGTAATGAGTAGCCAGTTAAAGGCGATTAATTCTGCTT

CCAGATAGTCTCCACTGTACATAAAAGTCACACTGTGTGCTTGCATTCCTGTATGGTAGTGGTGACTGTC

TCTCACACCACCTTCTCTATCACGTCACAGTTTTCTCCTCCTCAGCCTATGTCTGCATTCCCCAGAATTC

TCCACTTGTTCCCTGGCCCTGCTGCTGGACCCTGCTGTGTCTGGTAGGCAACTGTTTGTTGGTGCTTTTG

TAGGGTTAAGTTAAACTCTGAGATCTTGGGCAAAATGGCAAGGAGACCCAGGATTCTTCTCTCCAAAGGT

CACTCCGATGTTATTTTTGATTCCTGGGGCAGAAATATGACTCCTTTCCCTAGCCCAAGCCAGCCAAGAG

CTCTCATTCTTAGAAGAAAAGGCAGCCCTTGGTGCCTGTCCTCCTGCCTCGGCTGATTTGCAGAGTACT

TCTTCAAAAGAAAAAAATGGTAAAGCTATTTATTAAAAATTCTTTGTTTTTTGCTACAAATGATGCATA

TATTTTCACCCACACCAAGCACTTTGTTTCTAATATCTTTGATAAGAAAACTACATGTGCAGTATTTTAT

TAAAGCAACATTTTATTTA gi|7110682|ref|NM_011044.1| *Mus musculus*
phosphoenolpyruvate carboxykinase 1, cytosolic (Pck1), mRNA
ACAGTTGGCCTTCCCTCTGGGAACACACCCTCGGTCAACAGGGGAAATCCGGCAAGGCGCTCAGCGATCT    (SEQ ID NO: 6699)

CTGATCCAGACCTTCCAAAAGGAAGAAAGGTGGCACCAGAGTTCCTGCCTCTCTCCACACCATTGCAATT

ATGCCTCCTCAGCTGCATAACGGTCTGGACTTCTCTGCCAAGGTTATCCAGGGCAGCCTCGACAGCCTGC

CCCAGGCAGTGAGGAAGTTCGTGGAAGGCAATGCTCAGCTGTGCCAGCCGGAGTATATCCACATCTGCGA

TGGCTCCGAGGAGGAGTACGGGCAGTTGCTGGCCCACATGCAGGAGGAGGGTGTCATCCGCAAGCTGAAG

AAATATGACAACTGTTGGCTGGCTCTCACTGACCCTCGAGATGTGGCCAGGATCGAAAGCAAGACAGTCA

TCATCACCCAAGAGCAGAGAGACACAGTGCCCATCCCCAAAACTGGCCTCAGCCAGCTGGGCCGCTGGAT

GTCGGAAGAGGACTTTGAGAAAGCATTCAACGCCAGGTTCCCAGGGTGCATGAAAGGCCGCACCATGTAT

GTCATCCCATTCAGCATGGGCCACTGGGCTCGCCGCTGGCCAAGATTGGTATTGAACTGACAGACTCGC

CCTATGTGGTGGCCAGCATGCGGATCATGACTCGGATGGGCATATCTGTGCTGGAGGCCCTGGGAGATGG

GGAGTTCATCAAGTGCCTGCACTCTGTGGGGTGCCCTCTCCCCTTAAAAAAGCCTTTGGTCAACAACTGG

GCCTGCAACCCTGAGCTGACCCTGATCGCCCACCTCCCGGACCGCAGAGAGATCATCTCCTTTGGAAGCG

GATATGGTGGGAACTCACTACTCGGGAAGAAATGCTTTGCGTTGCGGATCGCCAGCCGTCTGGCTAAGGA

GGAAGGGTGGCTGGCGGAGCATATGCTGATCCTGGGCATAACTAACCCCGAAGGCAAGAAGAAATACCTG

GCCGCAGCCTTCCCTAGTGCCTGTGGGAAGACTAACTTGGCCATGATGAACCCCAGCCTGCCCGGGTGGA

AGGTCGAATGTGTGGGCGATGACATTGCCTGGATGAAGTTTGATGCCCAAGGCAACTTAAGGGCTATCAA

CCCAGAAAACGGGTTTTTTGGAGTTGCTCCTGGCACCTCAGTGAAGACAAATCCAAATGCCATTAAAACC

ATCCAGAAAACACCATCTTCACCAACGTGGCCGAGACTAGCGATGGGGGTGTTTACTGGGAAGGCATCG

ATGAGCCGCTGGCCCCGGGAGTCACCATCACCTCCTGGAAGAACAAGGAGTGGAGACCGCAGGACGCGGA

TABLE 15-continued

Sequences of Exemplary Gene Targets

```
ACCATGTGCCCATCCCAACTCGAGATTCTGCACCCCTGCCAGCCAGTGCCCCATTATTGACCCTGCCTGG
GAATCTCCAGAAGGAGTACCCATTGAGGGTATCATCTTTGGTGGCCGTAGACCTGAAGGTGTCCCCCTTG
TCTATGAAGCCCTCAGCTGGCAGCATGGGGTGTTTGTAGGAGCAGCCATGAGATCTGAGGCCACAGCTGC
TGCAGAACACAAGGGCAAGATCATCATGCACGACCCCTTTGCCATGCGACCCTTCTTCGGCTACAACTTC
GGCAAATACCTGGCCCACTGGCTGAGCATGGCCCACCGCCCAGCAGCCAAGTTGCCCAAGATCTTCCATG
TCAACTGGTTCCGGAAGGACAAAGATGGCAAGTTCCTCTGGCCAGGCTTTGGCGAGAACTCCCGGGTGCT
GGAGTGGATGTTCGGGCGGATTGAAGGGGAAGACAGCGCCAAGCTCACGCCCATCGGCTACATCCCTAAG
GAAAACGCCTTGAACCTGAAAGGCCTGGGGGGCGTCAACGTGGAGGAGCTGTTTGGGATCTCTAAGGAGT
TCTGGGAGAAGGAGGTGGAGGAGATCGACAGGTATCTGGAGGACCAGGTCAACACCGACCTCCCTTACGA
AATTGAGAGGGAGCTCCGAGCCCTGAAACAGAGAATCAGCCAGATGTAAATCCCAATGGGGGCGTCTCGA
GAGTCACCCCTTCCCACTCACAGCATCGCTGAGATCTAGGAGAAAGCCAGCCTGCTCCAGCTTTGAGATA
GCGGCACAATCGTGAGTAGATCAGAAAAGCACCTTTTAATAGTCAGTTGAGTAGCACAGAGAACAGGCTA
GGGGCAAATAAGATTGGGAGGGGAAATCACCGCATAGTCTCTGAAGTTTGCATTTGACACCAATGGGGGT
TTTGGTTCCACTTCAAGGTCACTCAGGAATCCAGTTCTTCACGTTAGCTGTAGCAGTTAGCTAAAATGCA
CAGAAAACATACTTGAGCTGTATATATGTGTGTGAACGTGTCTCTGTGTGAGCATGTGTGTGTGTGTGTG
TGTGTGTGTGTGTGTGTGTGTGTGTGTGTGTACATGCCTGTCTGTCCCATTGTCCACAGTATATTTAA
AACCTTTGGGGAAAAATCTTGGGCAAATTTGTAGCTGTAACTAGAGAGTCATGTTGCTTTGTTGCTAGTA
TGTATGTTTAAATTATTTTTATACACCGCCCTTACCTTTCTTTACATAATTGAAATTGGTATCCGGACCA
CTTCTTGGGAAAAAAATTACAAAATAAA
```

Example 6 siRNAs Decrease mRNA Levels In Vivo

Male CMV-Luc mice (8-10 weeks old) from Xenogen (Cranbury, N.J.) were administered cholesterol conjugated siRNA (see Table 16).

TABLE 16

Solutions adminstered to mice

| Group | n | Injection Mix |
|---|---|---|
| 1 | 7 | Buffer (PBS [pH 7.4]) |
| 2 | 8 | Cholesterol conjugated siRNA (ALN-3001) |

TABLE 17

Test iRNA agents targeting Luciferase

| siRNA | Sequence | |
|---|---|---|
| ALN-1070 | 5'-GAA CUG UGU GUG AGA GGU CCU-3' | (SEQ ID NO: 6700) |
| | 3'-CG CUU GAC ACA CAC UCU CCA GGA-5' | (SEQ ID NO: 6701) |
| ALN-1000 | 5'-GAA CUG UGU GUG AGA GGU CCU-GS-3' | (SEQ ID NO: 6702) |
| | 3'-CG CUU GAC ACA CAC UCU CCA GGA-5' | (SEQ ID NO: 6703) |
| ALN-3000 | 5'-GAA CUG UGU GUG AGA GGU CCU-3' | (SEQ ID NO: 6704) |
| | 3'-Cs$^l$Gs$^l$ CUU GAC ACA CAC UCU CCA GGA-5' | (SEQ ID NO: 6705) |

TABLE 17-continued

Test iRNA agents targeting Luciferase

| siRNA | Sequence | |
|---|---|---|
| ALN-3001 | 5'-GAA CUG UGU GUG AGA GGU CCU-chol.[2]-3'<br>3'-Cs[1]Gs[1] CUU GAC ACA CAC UCU CCA GGA-5' | (SEQ ID NO: 6706)<br>(SEQ ID NO: 6707) |

[1] 2' O-Me group is attached to the nucleotide and the nucleotides have phosphorothioate linkages (indicated by "s")
[2] cholesterol is conjugated to the antisense strand via the linker: U-pyrroline carrier-C(O)-(CH$_2$)$_5$-NHC(O)-cholesterol (via cholesterol C-3 hydroxyl).

Animals were injected (tail vein) with a volume of 200-250 µl test solution containing buffer or an siRNA solution. Group 1 received buffer and group 2 received cholesterol conjugated siRNA (ALN-3001) at a dose of 50 mg/kg body weight. Twenty-two hours after injection, animals were sacrificed and livers collected. Organs were snap frozen on dry ice, then pulverized in a mortar and pestle.

For Luciferase mRNA analysis (by the QuantiGene Assay (Genospectra, Inc.; Fremont, Calif.)), approximately 10 mg of tissue powder was resuspended in tissue lysis buffer, and processed according to the manufacturer's protocol. Samples of the lysate were hybridized with probes specific for Luciferase or GAPDH (designed using ProbeDesigner software (Genospectra, Inc., Fremont, Calif.) in triplicate, and processed for luminometric analysis. Values for Luciferase were normalized to GAPDH. Mean values were plotted with error bars corresponding to the standard deviation of the Luciferase measurements.

Figure 6A:
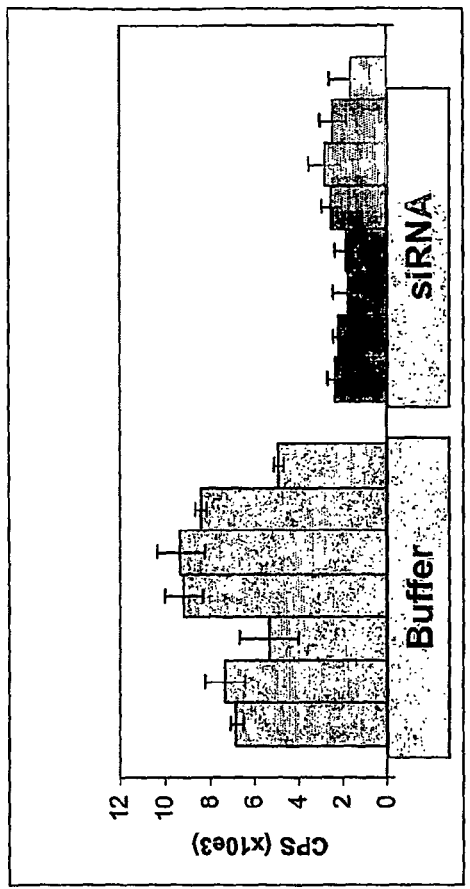
FIG. 6A. is a graph depicting levels of luciferase mRNA in livers of CMV-Luc mice (Xanogen) following intervenous injection (iv) of buffer or siRNA into the tail vein. Each bar represents data from one mouse. RNA levels were quantified by QuantiGene Assay (Genospectra, Inc.; Fremont, Calif.)). The Y axis represents chemiluminescence values in counts per second (CPS).
Figure 6B:
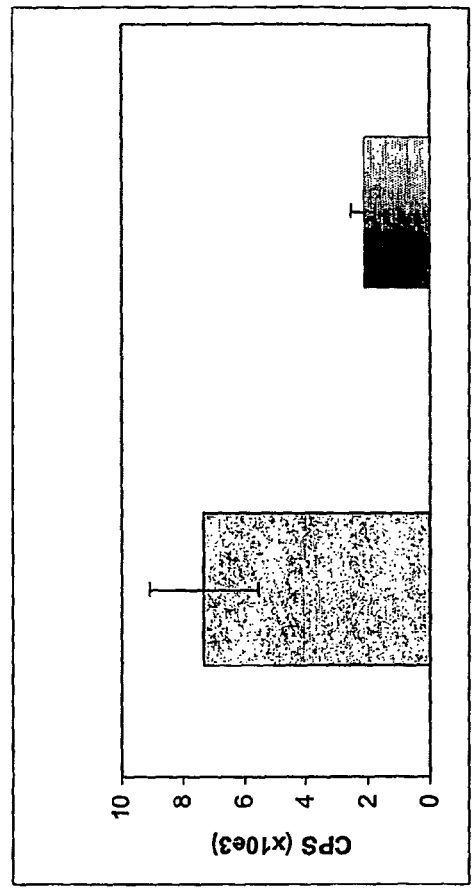
FIG. 6B. is a graph depicting levels of luciferase mRNA in livers of CMV-Luc mice (Xanogen). The values are averaged from the data depicted in FIG. 6A.

Results indicated that the level of luciferase RNA in animals injected with cholesterol conjugated siRNA was reduced by about 70% as compared to animals injected with buffer (see FIGS. 6A and 6b).

In Vitro Activity

HeLa cells expressing luciferase were transfected with each of the siRNAs listed in Table 17. ALN-1000 siRNAs were most effective at decreasing luciferase mRNA levels (~0.6 nM siRNA decreased mRNA levels to about ~65% the original expression level, and 1.0 nM siRNA decreased levels to about ~20% the original expression level); ALN-3001 siRNAs were least effective (~0.6 nM siRNA had a negligible mRNA levels, and 1.0 nM siRNA decreased levels to about ~40% the original expression level).

Pharmacokinetics/Biodistribution

Figure 7:
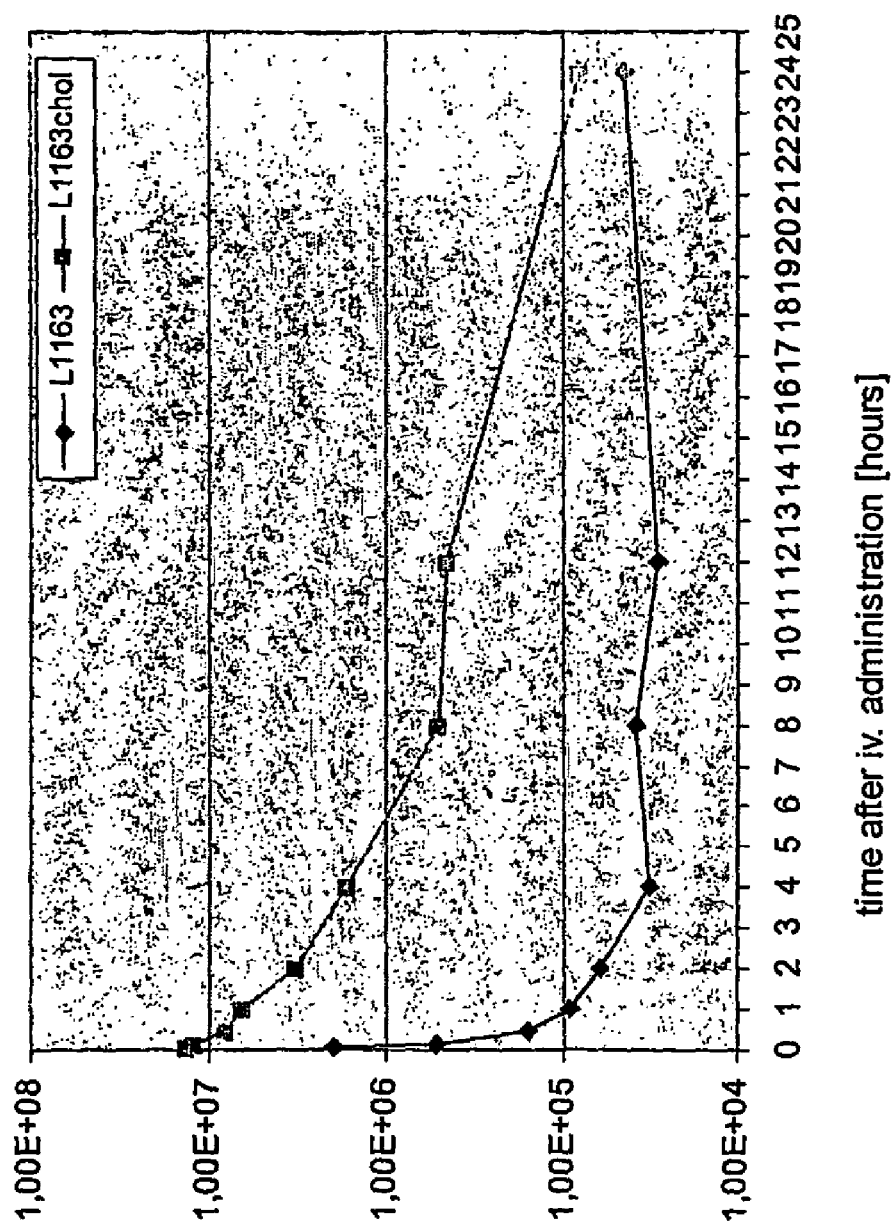
FIG. 7 is a graph depicting the pharmacokinetics of cholesterol-conjugated and unconjugated siRNA. The diamonds represent the amount of unconjugated $^{33}$P-labeled siRNA (ALN-3000) in mouse plasma over time; the squares represent the amount of cholesterol-conjugated $^{33}$P-labeled siRNA (ALN-3001) in mouse plasma over time. "L1163" is equivalent to ALN3000; "L1163Chol" is equivalent to ALN-3001.

Pharmacokinetic analyses were performed in mice and rats. Test siRNA molecules were radioactively labeled with $^{33}$P on the antisense strand by splint ligation. Labeled siRNAs (50 mg/kg) were administered by tail vein injection, and plasma levels of siRNA were measured periodically over 24 hrs by scintillation counting. Cholesterol conjugated siRNA (ALN-3001) was discovered to circulate in mouse plasma for a longer period time than unconjugated siRNA (ALN-3000) (FIG. 7). RNAse protection assays indicated that cholesterol-conjugated siRNA (ALN-3001) was detectable in mouse plasma 12 hours after injection, whereas unconjugated siRNA (ALN-3000) was not detectable in mouse plasma within two hours following injection. Similar results were observed in rats.

Mouse liver was harvested at varying time points (ranging from 0.08-24 hours) following injection with siRNA, and siRNA localized to the liver was quantified. Over the time period tested, the amount of cholesterol-conjugated siRNA (ALN-3001) detected in the liver ranged from 14.3-3.55 percent of the total dose administered to the mouse. The amount of unconjugated siRNA (ALN-3000) detected in the liver was lower, ranging from 3.91-1.75 percent of the total dose administered.

Detection of siRNA in Different Tissues

Various tissues and organs (fat, heart, kidney, liver, and spleen) were harvested from two CMV-Luc mice 22 hours following injection with 50 mg/kg ALN-3001. The antisense strand of the siRNA was detected by RNAse protection assay. The liver contained the greatest concentration of siRNA (~8-10 µg siRNA/g tissue); the spleen, heart and kidney contained lesser amounts of siRNA (~2-7 µg siRNA/g tissue); and fat tissue contained the least amount of siRNA (<~1 µg siRNA/g tissue).

Glucose-6-Phosphatase siRNA Detection by RNAse Protection Assay

Balbc mice were injected with U/U, 3'C/U, or 3' C/3' C siRNA (4 mg/kg) targeting glucose-6-phosphatase (G6Pase) (see Table 18). Administration was by hydrodynamic tail vein injection (hd) or non-hydrodynamic tail vein injection (iv), and siRNA was subsequently detected in the liver by RNAse protection assay.

TABLE 18

Test iRNA agents targeting glucose-6-phosphatase

| siRNA | Description |
|---|---|
| U/U | No cholesterol; dinucleotide 3' overhangs on sense and antisense strands |
| 3'C/U | dinucleotide 3' overhangs on sense and antisense strands; cholesterol conjugated to 3' end of sense strand (mono-conjugate) |
| 3'C/3'C | dinucleotide 3' overhangs on sense and antisense strands; cholesterol conjugated to 3' end of both sense and antisense strands (bis-conjugate) |

Unconjugated siRNA (U/U) delivered by hd was detected by 15 min. post-injection (the earliest determined time-point) and was still detectable in the liver 18 hours post-injection.

Delivery by normal iv administration resulted in the greatest concentration of 3'C/3'C siRNA (the bis-cholesterol-conjugate) in the liver 1 hour post injection (as compared to the mono-cholesterol-conjugate 3'C/3'U siRNA). At 18 hours post injection, 3'C/3'C siRNAs and 3'C/U siRNA were still detectable in the liver with the bis-conjugate at higher levels compared to the mono-conjugate.

While this invention has been particularly shown and described with reference to preferred embodiments thereof, it will be understood by those skilled in the art that various changes in form and details may be made therein without departing from the scope of the invention encompassed by the appended claims.

SEQUENCE LISTING (6756 sequences)

SEQ ID NO: 1 - DNA, 19 bp, Homo sapiens
ggccattccagaagggaag

SEQ ID NO: 2 - DNA, 19 bp, Homo sapiens
tgccatctcgagagttcca

SEQ ID NO: 3 - DNA, 19 bp, Homo sapiens
catgtcaaacactttgtta

SEQ ID NO: 4 - DNA, 19 bp, Homo sapiens
tttgttataaatcttattg

SEQ ID NO: 5 - DNA, 19 bp, Homo sapiens
tctggaaaagggtcatgga

SEQ ID NO: 6 - DNA, 19 bp, Homo sapiens
cagctcttgttcaggtcca

SEQ ID NO: 7 - DNA, 19 bp, Homo sapiens
ggaggttccccagctctgc

SEQ ID NO: 8 - DNA, 19 bp, Homo sapiens
ctgttttgaagactctcca

SEQ ID NO: 9 - DNA, 19 bp, Homo sapiens
agtggctgaaacgtgtgca

SEQ ID NO: 10 - DNA, 19 bp, Homo sapiens
ccaaaatagaagggaatct

SEQ ID NO: 11 - DNA, 19 bp, Homo sapiens
tgaagagaagattgaattt

SEQ ID NO: 12 - DNA, 19 bp, Homo sapiens
agtggtggcaacaccagca

SEQ ID NO: 13 - DNA, 19 bp, Homo sapiens
aaggctccacaagtcatca

SEQ ID NO: 14 - DNA, 19 bp, Homo sapiens
gtcagccaggtttatagca

SEQ ID NO: 15 - DNA, 19 bp, Homo sapiens
tgatatctggaaccttgaa

SEQ ID NO: 16 - DNA, 19 bp, Homo sapiens
gtcaagttgagcaatttct

SEQ ID NO: 17 - DNA, 19 bp, Homo sapiens
atccagatggaaaagggaa

SEQ ID NO: 18 - DNA, 19 bp, Homo sapiens
atttgtttgtcaaagaagt

SEQ ID NO: 19 - DNA, 19 bp, Homo sapiens
ctggaaaatgtcagcctgg

SEQ ID NO: 20 - DNA, 19 bp, Homo sapiens
accaggaggttcttcttca

SEQ ID NO: 21 - DNA, 19 bp, Homo sapiens
aaagaagttctgaaagaat

SEQ ID NO: 22 - DNA, 19 bp, Homo sapiens
gctacagcttatggctcca

SEQ ID NO: 23 - DNA, 19 bp, Homo sapiens
atcaatattgatcaatttg

SEQ ID NO: 24 - DNA, 19 bp, Homo sapiens
gaattatcttttaaaacat

SEQ ID NO: 25 - DNA, 19 bp, Homo sapiens
cgaggcccgcgctgctggc

SEQ ID NO: 26 - DNA, 19 bp, Homo sapiens
acaactatgaggctgagag

SEQ ID NO: 27 - DNA, 19 bp, Homo sapiens
gctgagagttccagtggag

SEQ ID NO: 28 - DNA, 19 bp, Homo sapiens
tgaagaaaaccaagaactc

SEQ ID NO: 29 - DNA, 19 bp, Homo sapiens
cctacttacatcctgaaca

SEQ ID NO: 30 - DNA, 19 bp, Homo sapiens
ctacttacatcctgaacat

SEQ ID NO: 31 - DNA, 19 bp, Homo sapiens
gagacagaagaagccaagc

SEQ ID NO: 32 - DNA, 19 bp, Homo sapiens
cactcactttaccgtcaag

SEQ ID NO: 33 - DNA, 19 bp, Homo sapiens
ctgatcagcagcagccagt

SEQ ID NO: 34 - DNA, 19 bp, Homo sapiens
actggacgctaagaggaag

SEQ ID NO: 35 - DNA, 19 bp, Homo sapiens
agaggaagcatgtggcaga

SEQ ID NO: 36 - DNA, 19 bp, Homo sapiens
tgaagactctccaggaact

SEQ ID NO: 37 - DNA, 19 bp, Homo sapiens
ctctgagcaaaatatccag

SEQ ID NO: 38 - DNA, 19 bp, Homo sapiens
atgaagcagtcacatctct

SEQ ID NO: 39 - DNA, 19 bp, Homo sapiens
ttgccacagctgattgagg

SEQ ID NO: 40 - DNA, 19 bp, Homo sapiens
agctgattgaggtgtccag

SEQ ID NO: 41 - DNA, 19 bp, Homo sapiens
tgctccactcacatcctcc

SEQ ID NO: 42 - DNA, 19 bp, Homo sapiens
tgaaacgtgtgcatgccaa

SEQ ID NO: 43 - DNA, 19 bp, Homo sapiens
gacattgctaattacctga

SEQ ID NO: 44 - DNA, 19 bp, Homo sapiens
ttcttcttcagactttcct

SEQ ID NO: 45 - DNA, 19 bp, Homo sapiens
ccaatatcttgaactcaga

SEQ ID NO: 46 - DNA, 19 bp, Homo sapiens
aaagttagtgaaagaagtt

SEQ ID NO: 47 - DNA, 19 bp, Homo sapiens
aagttagtgaaagaagttc

SEQ ID NO: 48 - DNA, 19 bp, Homo sapiens
aaagaagttctgaaagaat

SEQ ID NO: 49 - DNA, 19 bp, Homo sapiens
tttggctataccaaagatg

SEQ ID NO: 50 - DNA, 19 bp, Homo sapiens
tgttgagaagctgattaaa

SEQ ID NO: 51 - DNA, 19 bp, Homo sapiens
caggaagggctcaaagaat

SEQ ID NO: 52 - DNA, 19 bp, Homo sapiens
aggaagggctcaaagaatg

SEQ ID NO: 53 - DNA, 19 bp, Homo sapiens
gaagggctcaaagaatgac

SEQ ID NO: 54 - DNA, 19 bp, Homo sapiens
caaagaatgacttttttct

SEQ ID NO: 55 - DNA, 19 bp, Homo sapiens
catggagaatgcctttgaa

SEQ ID NO: 56 - DNA, 19 bp, Homo sapiens
ggagccaaggctggagtaa

SEQ ID NO: 57 - DNA, 19 bp, Homo sapiens
tcattccttccccaaagag

SEQ ID NO: 58 - DNA, 19 bp, Homo sapiens
acctatgagctccagagag

SEQ ID NO: 59 - DNA, 19 bp, Homo sapiens
gggcaaaacgtcttacaga

SEQ ID NO: 60 - DNA, 19 bp, Homo sapiens
accctggacattcagaaca

SEQ ID NO: 61 - DNA, 19 bp, Homo sapiens
atgggcgacctaagttgtg

SEQ ID NO: 62 - DNA, 19 bp, Homo sapiens
gatgaagagaagattgaat

SEQ ID NO: 63 - DNA, 19 bp, Homo sapiens
caatgtagataccaaaaaa

SEQ ID NO: 64 - DNA, 19 bp, Homo sapiens
gtagataccaaaaaaatga

SEQ ID NO: 65 - DNA, 19 bp, Homo sapiens
gcttcagttcatttggact

SEQ ID NO: 66 - DNA, 19 bp, Homo sapiens
tttgtttgtcaaagaagtc

SEQ ID NO: 67 - DNA, 19 bp, Homo sapiens
ttgtttgtcaaagaagtca

SEQ ID NO: 68 - DNA, 19 bp, Homo sapiens
tggcaatgggaaactcgct

SEQ ID NO: 69 - DNA, 19 bp, Homo sapiens
aacctctggcatttacttt

SEQ ID NO: 70 - DNA, 19 bp, Homo sapiens
catttactttctctcatga

SEQ ID NO: 71 - DNA, 19 bp, Homo sapiens
aaagtcagtgccctgctta

SEQ ID NO: 72 - DNA, 19 bp, Homo sapiens
tcccattttttgagacctt

SEQ ID NO: 73 - DNA, 19 bp, Homo sapiens
catcaatattgatcaattt

SEQ ID NO: 74 - DNA, 19 bp, Homo sapiens
taaagatagttatgattta

SEQ ID NO: 75 - DNA, 19 bp, Homo sapiens
tattgatgaaatcattgaa

SEQ ID NO: 76 - DNA, 19 bp, Homo sapiens
atgatctacatttgtttat

SEQ ID NO: 77 - DNA, 19 bp, Homo sapiens
agagacacatacagaatat

SEQ ID NO: 78 - DNA, 19 bp, Homo sapiens
gacacatacagaatataga

SEQ ID NO: 79 - DNA, 19 bp, Homo sapiens
agcatgtcaaacactttgt

SEQ ID NO: 80 - DNA, 19 bp, Homo sapiens
tttttagaggaaaccaagg

SEQ ID NO: 81 - DNA, 19 bp, Homo sapiens
ttttagaggaaaccaaggc

SEQ ID NO: 82 - DNA, 19 bp, Homo sapiens
ggaagatagacttcctgaa

SEQ ID NO: 83 - DNA, 19 bp, Homo sapiens
cactgtttctgagtcccag

SEQ ID NO: 84 - DNA, 19 bp, Homo sapiens
cacaaatcctttggctgtg

SEQ ID NO: 85 - DNA, 19 bp, Homo sapiens
ttcctggatacactgttcc

SEQ ID NO: 86 - DNA, 19 bp, Homo sapiens
gaaatctcaagctttctct

SEQ ID NO: 87 - DNA, 19 bp, Homo sapiens
tttcttcatcttcatctgt

SEQ ID NO: 88 - DNA, 19 bp, Homo sapiens
tctaccgctaaaggagcag

SEQ ID NO: 89 - DNA, 19 bp, Homo sapiens
ctaccgctaaaggagcagt

SEQ ID NO: 90 - DNA, 19 bp, Homo sapiens
agggcctctttttcaccaa

SEQ ID NO: 91 - DNA, 19 bp, Homo sapiens
ttctccatccctgtaaaag

SEQ ID NO: 92 - DNA, 19 bp, Homo sapiens
gaaaaacaaagcagattat

SEQ ID NO: 93 - DNA, 19 bp, Homo sapiens
actcactcattgattttct

SEQ ID NO: 94 - DNA, 19 bp, Homo sapiens
taaactaatagatgtaatc

SEQ ID NO: 95 - DNA, 19 bp, Homo sapiens
caaaacgagcttcaggaag

SEQ ID NO: 96 - DNA, 19 bp, Homo sapiens
tggaataatgctcagtgtt

SEQ ID NO: 97 - DNA, 19 bp, Homo sapiens
gatttgaaatccaaagaag

SEQ ID NO: 98 - DNA, 19 bp, Homo sapiens
atttgaaatccaaagaagt

SEQ ID NO: 99 - DNA, 19 bp, Homo sapiens
atcaacagccgcttctttg

SEQ ID NO: 100 - DNA, 19 bp, Homo sapiens
tgttttgaagactctccag

SEQ ID NO: 101 - DNA, 19 bp, Homo sapiens
cccttctgatagatgtggt

SEQ ID NO: 102 - DNA, 19 bp, Homo sapiens
tgagcaagtgaagaacttt

SEQ ID NO: 103 - DNA, 19 bp, Homo sapiens
atttgaaatccaaagaagt

SEQ ID NO: 104 - DNA, 19 bp, Homo sapiens
atccaaagaagtcccggaa

SEQ ID NO: 105 - DNA, 19 bp, Homo sapiens
agagcctacctccgcatct

SEQ ID NO: 106 - DNA, 19 bp, Homo sapiens
aatgcctttgaactcccca

SEQ ID NO: 107 - DNA, 19 bp, Homo sapiens
gaagtccaaattccggatt

SEQ ID NO: 108 - DNA, 19 bp, Homo sapiens
tgcaagcagaagccagaag

SEQ ID NO: 109 - DNA, 19 bp, Homo sapiens
gaagagaagattgaatttg

SEQ ID NO: 110 - DNA, 19 bp, Homo sapiens
atgctaaaggcacatatgg

SEQ ID NO: 111 - DNA, 19 bp, Homo sapiens
tccctcacctccacctctg

SEQ ID NO: 112 - DNA, 19 bp, Homo sapiens
atttacagctctgacaagt

SEQ ID NO: 113 - DNA, 19 bp, Homo sapiens
aggagcctaccaaaataat

SEQ ID NO: 114 - DNA, 19 bp, Homo sapiens
aaagctgaagcacatcaat

SEQ ID NO: 115 - DNA, 19 bp, Homo sapiens
ctgctggaaacaacgagaa

SEQ ID NO: 116 - DNA, 19 bp, Homo sapiens
ttgaaggaattcttgaaaa

SEQ ID NO: 117 - DNA, 19 bp, Homo sapiens
gaagtaaaagaaaattttg

SEQ ID NO: 118 - DNA, 19 bp, Homo sapiens
tgaagaagatggcaaattt

SEQ ID NO: 119 - DNA, 19 bp, Homo sapiens
aggatctgagttattttgc

SEQ ID NO: 120 - DNA, 19 bp, Homo sapiens
gtgcccttctcggttgctg

SEQ ID NO: 121 - DNA, 19 bp, Homo sapiens
ggcgctgcctgcgctgctg

SEQ ID NO: 122 - DNA, 19 bp, Homo sapiens
ctgcgctgctgctgctgct

SEQ ID NO: 123 - DNA, 19 bp, Homo sapiens
gctgctggcgggcgccagg

SEQ ID NO: 124 - DNA, 19 bp, Homo sapiens
aagaggaaatgctggaaaa

SEQ ID NO: 125 - DNA, 19 bp, Homo sapiens
ctggaaaatgtcagcctgg

SEQ ID NO: 126 - DNA, 19 bp, Homo sapiens
tggagtccctgggactgct

SEQ ID NO: 127 - DNA, 19 bp, Homo sapiens
ggagtccctgggactgctg

SEQ ID NO: 128 - DNA, 19 bp, Homo sapiens
tgggactgctgattcaaga

SEQ ID NO: 129 - DNA, 19 bp, Homo sapiens
ctgctgattcaagaagtgc

SEQ ID NO: 130 - DNA, 19 bp, Homo sapiens
tgccaccaggatcaactgc

SEQ ID NO: 131 - DNA, 19 bp, Homo sapiens
gccaccaggatcaactgca

SEQ ID NO: 132 - DNA, 19 bp, Homo sapiens
tgcaaggttgagctggagg

SEQ ID NO: 133 - DNA, 19 bp, Homo sapiens
caaggttgagctggaggtt

SEQ ID NO: 134 - DNA, 19 bp, Homo sapiens
ctctgcagcttcatcctga

SEQ ID NO: 135 - DNA, 19 bp, Homo sapiens
cagcttcatcctgaagacc

SEQ ID NO: 136 - DNA, 19 bp, Homo sapiens
gcttcatcctgaagaccag

SEQ ID NO: 137 - DNA, 19 bp, Homo sapiens
tcatcctgaagaccagcca

SEQ ID NO: 138 - DNA, 19 bp, Homo sapiens
gaaaaccaagaactctgag

SEQ ID NO: 139 - DNA, 19 bp, Homo sapiens
agaactctgaggagtttgc

SEQ ID NO: 140 - DNA, 19 bp, Homo sapiens
tctgaggagtttgctgcag

SEQ ID NO: 141 - DNA, 19 bp, Homo sapiens
tttgctgcagccatgtcca

SEQ ID NO: 142 - DNA, 19 bp, Homo sapiens
caagaggggcatcatttct

SEQ ID NO: 143 - DNA, 19 bp, Homo sapiens
tcactttaccgtcaagacg

SEQ ID NO: 144 - DNA, 19 bp, Homo sapiens
tttaccgtcaagacgagga

SEQ ID NO: 145 - DNA, 19 bp, Homo sapiens
cactggacgctaagaggaa

SEQ ID NO: 146 - DNA, 19 bp, Homo sapiens
aggaagcatgtggcagaag

SEQ ID NO: 147 - DNA, 19 bp, Homo sapiens
caaggagcaacacctcttc

SEQ ID NO: 148 - DNA, 19 bp, Homo sapiens
acagactttgaaacttgaa

SEQ ID NO: 149 - DNA, 19 bp, Homo sapiens
tgatgaagcagtcacatct

SEQ ID NO: 150 - DNA, 19 bp, Homo sapiens
agcagtcacatctctcttg

SEQ ID NO: 151 - DNA, 19 bp, Homo sapiens
ccagccccatcactttaca

SEQ ID NO: 152 - DNA, 19 bp, Homo sapiens
ctccactcacatcctccag

SEQ ID NO: 153 - DNA, 19 bp, Homo sapiens
catgccaacccccttctga

SEQ ID NO: 154 - DNA, 19 bp, Homo sapiens
gagagatcttcaacatggc

SEQ ID NO: 155 - DNA, 19 bp, Homo sapiens
tcaacatggcgagggatca

SEQ ID NO: 156 - DNA, 19 bp, Homo sapiens
ccaccttgtatgcgctgag

SEQ ID NO: 157 - DNA, 19 bp, Homo sapiens
gtcaacaactatcataaga

SEQ ID NO: 158 - DNA, 19 bp, Homo sapiens
tggacattgctaattacct

SEQ ID NO: 159 - DNA, 19 bp, Homo sapiens
ggacattgctaattacctg

SEQ ID NO: 160 - DNA, 19 bp, Homo sapiens
ttctgcgggtcattggaaa

SEQ ID NO: 161 - DNA, 19 bp, Homo sapiens
ccagaactcaagtcttcaa

SEQ ID NO: 162 - DNA, 19 bp, Homo sapiens
agtcttcaatcctgaaatg

SEQ ID NO: 163 - DNA, 19 bp, Homo sapiens
tgagcaagtgaagaacttt

SEQ ID NO: 164 - DNA, 19 bp, Homo sapiens
agcaagtgaagaactttgt

SEQ ID NO: 165 - DNA, 19 bp, Homo sapiens
tctgaaagaatctcaactt

SEQ ID NO: 166 - DNA, 19 bp, Homo sapiens
actgtcatggacttcagaa

SEQ ID NO: 167 - DNA, 19 bp, Homo sapiens
acttgacccagcctcagcc

SEQ ID NO: 168 - DNA, 19 bp, Homo sapiens
tccaaataactaccttcct

SEQ ID NO: 169 - DNA, 19 bp, Homo sapiens
actaccctcactgcctttg

SEQ ID NO: 170 - DNA, 19 bp, Homo sapiens
ttggatttgcttcagctga

SEQ ID NO: 171 - DNA, 19 bp, Homo sapiens
ttggaagctctttttggga

SEQ ID NO: 172 - DNA, 19 bp, Homo sapiens
ggaagctctttttgggaag

SEQ ID NO: 173 - DNA, 19 bp, Homo sapiens
tttttcccagacagtgtca

SEQ ID NO: 174 - DNA, 19 bp, Homo sapiens
agacagtgtcaacaaagct

SEQ ID NO: 175 - DNA, 19 bp, Homo sapiens
ctttggctataccaaagat

SEQ ID NO: 176 - DNA, 19 bp, Homo sapiens
caaagatgataaacatgag

SEQ ID NO: 177 - DNA, 19 bp, Homo sapiens
gatatggtaaatggaataa

SEQ ID NO: 178 - DNA, 19 bp, Homo sapiens
ggaataatgctcagtgttg

SEQ ID NO: 179 - DNA, 19 bp, Homo sapiens
tttgaaatccaaagaagtc

SEQ ID NO: 180 - DNA, 19 bp, Homo sapiens
gatcccccagatgattgga

SEQ ID NO: 181 - DNA, 19 bp, Homo sapiens
cagatgattggagaggtca

SEQ ID NO: 182 - DNA, 19 bp, Homo sapiens
agaatgacttttttcttca

SEQ ID NO: 183 - DNA, 19 bp, Homo sapiens
gaactccccactggagctg

SEQ ID NO: 184 - DNA, 19 bp, Homo sapiens
atatcttcatctggagtca

SEQ ID NO: 185 - DNA, 19 bp, Homo sapiens
gtcattgctcccggagcca

SEQ ID NO: 186 - DNA, 19 bp, Homo sapiens
gctgaagtttatcattcct

SEQ ID NO: 187 - DNA, 19 bp, Homo sapiens
attccttccccaaagagac

SEQ ID NO: 188 - DNA, 19 bp, Homo sapiens
ctcattgagaacaggcagt

SEQ ID NO: 189 - DNA, 19 bp, Homo sapiens
ttgagcagtattctgtcag

SEQ ID NO: 190 - DNA, 19 bp, Homo sapiens
accttgtccagtgaagtcc

SEQ ID NO: 191 - DNA, 19 bp, Homo sapiens
ccagtgaagtccaaattcc

SEQ ID NO: 192 - DNA, 19 bp, Homo sapiens
acattcagaacaagaaaat

SEQ ID NO: 193 - DNA, 19 bp, Homo sapiens
gaaaaatcaagggtgttat

SEQ ID NO: 194 - DNA, 19 bp, Homo sapiens
aaatcaagggtgttatttc

SEQ ID NO: 195 - DNA, 19 bp, Homo sapiens
tggcattatgatgaagaga

SEQ ID NO: 196 - DNA, 19 bp, Homo sapiens
aagagaagattgaatttga

SEQ ID NO: 197 - DNA, 19 bp, Homo sapiens
aaatgacttccaatttccc

SEQ ID NO: 198 - DNA, 19 bp, Homo sapiens
atgacttccaatttccctg

SEQ ID NO: 199 - DNA, 19 bp, Homo sapiens
acttccaatttccctgtgg

SEQ ID NO: 200 - DNA, 19 bp, Homo sapiens
agttgcaatgagctcatgg

SEQ ID NO: 201 - DNA, 19 bp, Homo sapiens
tttgcaagaccacctcaat

SEQ ID NO: 202 - DNA, 19 bp, Homo sapiens
gaaggagttcaacctccag

SEQ ID NO: 203 - DNA, 19 bp, Homo sapiens
acttccacatcccagaaaa

SEQ ID NO: 204 - DNA, 19 bp, Homo sapiens
ctcttcttaaaaagcgatg

SEQ ID NO: 205 - DNA, 19 bp, Homo sapiens
aaaagcgatggccgggtca

SEQ ID NO: 206 - DNA, 19 bp, Homo sapiens
ttcctttgccttttggtgg

SEQ ID NO: 207 - DNA, 19 bp, Homo sapiens
caagtctgtgggattccat

SEQ ID NO: 208 - DNA, 19 bp, Homo sapiens
aagtccctacttttaccat

SEQ ID NO: 209 - DNA, 19 bp, Homo sapiens
tgcctctcctgggtgttct

SEQ ID NO: 210 - DNA, 19 bp, Homo sapiens
accagcacagaccatttca

SEQ ID NO: 211 - DNA, 19 bp, Homo sapiens
ccagcacagaccatttcag

SEQ ID NO: 212 - DNA, 19 bp, Homo sapiens
actatcatgtgatgggtct

SEQ ID NO: 213 - DNA, 19 bp, Homo sapiens
accacagatgtctgcttca

SEQ ID NO: 214 - DNA, 19 bp, Homo sapiens
ccacagatgtctgcttcag

SEQ ID NO: 215 - DNA, 19 bp, Homo sapiens
tttggactccaaaaagaaa

SEQ ID NO: 216 - DNA, 19 bp, Homo sapiens
tcaaagaagtcaagattga

SEQ ID NO: 217 - DNA, 19 bp, Homo sapiens
atgagaactacgagctgac

SEQ ID NO: 218 - DNA, 19 bp, Homo sapiens
ttaaaatctgacaccaatg

SEQ ID NO: 219 - DNA, 19 bp, Homo sapiens
gaagtataagaactttgcc

SEQ ID NO: 220 - DNA, 19 bp, Homo sapiens
aagtataagaactttgcca

SEQ ID NO: 221 - DNA, 19 bp, Homo sapiens
ttcttcagcctgctttctg

SEQ ID NO: 222 - DNA, 19 bp, Homo sapiens
ctggatcactaaattccca

SEQ ID NO: 223 - DNA, 19 bp, Homo sapiens
aaattaatagtggtgctca

SEQ ID NO: 224 - DNA, 19 bp, Homo sapiens
agtgcaacgaccaacttga

SEQ ID NO: 225 - DNA, 19 bp, Homo sapiens
ctgggaagtgcttatcagg

SEQ ID NO: 226 - DNA, 19 bp, Homo sapiens
gcaaaaacattttcaactt

SEQ ID NO: 227 - DNA, 19 bp, Homo sapiens
aaaaacattttcaacttca

SEQ ID NO: 228 - DNA, 19 bp, Homo sapiens
tcagtcaagaaggacttaa

SEQ ID NO: 229 - DNA, 19 bp, Homo sapiens
tcaaatgacatgatgggct

SEQ ID NO: 230 - DNA, 19 bp, Homo sapiens
cacacaaacagtctgaaca

SEQ ID NO: 231 - DNA, 19 bp, Homo sapiens
tcttcaaaacttgacaaca

SEQ ID NO: 232 - DNA, 19 bp, Homo sapiens
caagttttataagcaaact

SEQ ID NO: 233 - DNA, 19 bp, Homo sapiens
tggtaactactttaaacag

SEQ ID NO: 234 - DNA, 19 bp, Homo sapiens
aacagtgacctgaaataca

SEQ ID NO: 235 - DNA, 19 bp, Homo sapiens
gggaaactacggctagaac

SEQ ID NO: 236 - DNA, 19 bp, Homo sapiens
aacacatctatgccatctc

SEQ ID NO: 237 - DNA, 19 bp, Homo sapiens
tcagcaagctataaagcag

SEQ ID NO: 238 - DNA, 19 bp, Homo sapiens
gcagacactgttgctaagg

SEQ ID NO: 239 - DNA, 19 bp, Homo sapiens
tctggggagaacatactgg

SEQ ID NO: 240 - DNA, 19 bp, Homo sapiens
ttctctcatgattacaaag

SEQ ID NO: 241 - DNA, 19 bp, Homo sapiens
ctgagcagacaggcacctg

SEQ ID NO: 242 - DNA, 19 bp, Homo sapiens
caatttaacaacaatgaat

SEQ ID NO: 243 - DNA, 19 bp, Homo sapiens
tggacgaactctggctgac

SEQ ID NO: 244 - DNA, 19 bp, Homo sapiens
cttttactcagtgagccca

SEQ ID NO: 245 - DNA, 19 bp, Homo sapiens
tcattgatgctttagagat

SEQ ID NO: 246 - DNA, 19 bp, Homo sapiens
aaaaccaagatgttcactc

SEQ ID NO: 247 - DNA, 19 bp, Homo sapiens
aggaatcgacaaaccatta

SEQ ID NO: 248 - DNA, 19 bp, Homo sapiens
tagttgtactggaaaacgt

SEQ ID NO: 249 - DNA, 19 bp, Homo sapiens
ggaaaacgtacagagaaag

SEQ ID NO: 250 - DNA, 19 bp, Homo sapiens
gaaaacgtacagagaaagc

SEQ ID NO: 251 - DNA, 19 bp, Homo sapiens
aaagctgaagcacatcaat

SEQ ID NO: 252 - DNA, 19 bp, Homo sapiens
aagctgaagcacatcaata

SEQ ID NO: 253 - DNA, 19 bp, Homo sapiens
tgaagcacatcaatattga

SEQ ID NO: 254 - DNA, 19 bp, Homo sapiens
atcaatattgatcaatttg

SEQ ID NO: 255 - DNA, 19 bp, Homo sapiens
taatgattatctgaattca

SEQ ID NO: 256 - DNA, 19 bp, Homo sapiens
gattatctgaattcattca

SEQ ID NO: 257 - DNA, 19 bp, Homo sapiens
aattgggagagacaagttt

SEQ ID NO: 258 - DNA, 19 bp, Homo sapiens
aaaatagctattgctaata

SEQ ID NO: 259 - DNA, 19 bp, Homo sapiens
aaaattaaaaagtcttgat

SEQ ID NO: 260 - DNA, 19 bp, Homo sapiens
ttgaaaatattgattttaa

SEQ ID NO: 261 - DNA, 19 bp, Homo sapiens
agacatccagcacctagct

SEQ ID NO: 262 - DNA, 19 bp, Homo sapiens
caatttcatttgaaagaat

SEQ ID NO: 263 - DNA, 19 bp, Homo sapiens
aggttttaatggataaatt

SEQ ID NO: 264 - DNA, 19 bp, Homo sapiens
cagaagctaagcaatgtcc

SEQ ID NO: 265 - DNA, 19 bp, Homo sapiens
taagataaaagattacttt

SEQ ID NO: 266 - DNA, 19 bp, Homo sapiens
aaagattactttgagaaat

SEQ ID NO: 267 - DNA, 19 bp, Homo sapiens
gagaaattagttggattta

SEQ ID NO: 268 - DNA, 19 bp, Homo sapiens
atttattgatgatgctgtc

SEQ ID NO: 269 - DNA, 19 bp, Homo sapiens
gaattatcttttaaaacat

SEQ ID NO: 270 - DNA, 19 bp, Homo sapiens
ttaccaccagtttgtagat

SEQ ID NO: 271 - DNA, 19 bp, Homo sapiens
ttgcagtgtatctggaaag

SEQ ID NO: 272 - DNA, 19 bp, Homo sapiens
cattcagcaggaacttcaa

SEQ ID NO: 273 - DNA, 19 bp, Homo sapiens
acacctgattttatagtcc

SEQ ID NO: 274 - DNA, 19 bp, Homo sapiens
ggattccatcagttcagat

SEQ ID NO: 275 - DNA, 19 bp, Homo sapiens
ttgtagaaatgaaagtaaa

SEQ ID NO: 276 - DNA, 19 bp, Homo sapiens
ctgaacagtgagctgcagt

SEQ ID NO: 277 - DNA, 19 bp, Homo sapiens
aatccaatctcctcttttc

SEQ ID NO: 278 - DNA, 19 bp, Homo sapiens
attttgattttcaagcaaa

SEQ ID NO: 279 - DNA, 19 bp, Homo sapiens
ttttgattttcaagcaaat

SEQ ID NO: 280 - DNA, 19 bp, Homo sapiens
tgattttcaagcaaatgca

SEQ ID NO: 281 - DNA, 19 bp, Homo sapiens
atgctgttttttggaaatg

SEQ ID NO: 282 - DNA, 19 bp, Homo sapiens
tgctgttttttggaaatgc

SEQ ID NO: 283 - DNA, 19 bp, Homo sapiens
aaaaaaatacactggagct

SEQ ID NO: 284 - DNA, 19 bp, Homo sapiens
actggagcttagtaatgga

SEQ ID NO: 285 - DNA, 19 bp, Homo sapiens
cttctggaaaagggtcatg

SEQ ID NO: 286 - DNA, 19 bp, Homo sapiens
ggaaaagggtcatggaaat

SEQ ID NO: 287 - DNA, 19 bp, Homo sapiens
gggcctgccccagattctc

SEQ ID NO: 288 - DNA, 19 bp, Homo sapiens
ttctcagatgagggaacac

SEQ ID NO: 289 - DNA, 19 bp, Homo sapiens
gatgagggaacacatgaat

SEQ ID NO: 290 - DNA, 19 bp, Homo sapiens
ctttggactgtccaataag

SEQ ID NO: 291 - DNA, 19 bp, Homo sapiens
gcatccacaaacaatgaag

SEQ ID NO: 292 - DNA, 19 bp, Homo sapiens
cacaaacaatgaagggaat

SEQ ID NO: 293 - DNA, 19 bp, Homo sapiens
ccaaaatttctctgctgga

SEQ ID NO: 294 - DNA, 19 bp, Homo sapiens
caaaatttctctgctggaa

SEQ ID NO: 295 - DNA, 19 bp, Homo sapiens
tctgctggaaacaacgaga

SEQ ID NO: 296 - DNA, 19 bp, Homo sapiens
ctgctggaaacaacgagaa

SEQ ID NO: 297 - DNA, 19 bp, Homo sapiens
agaacattatggaggccca

SEQ ID NO: 298 - DNA, 19 bp, Homo sapiens
agaagcaaatctggatttc

SEQ ID NO: 299 - DNA, 19 bp, Homo sapiens
tttctctctatgggaaaaa

SEQ ID NO: 300 - DNA, 19 bp, Homo sapiens
tcagagcatcaaatccttt

SEQ ID NO: 301 - DNA, 19 bp, Homo sapiens
cagaaacaatgcattagat

SEQ ID NO: 302 - DNA, 19 bp, Homo sapiens
tacacattaatcctgccat

SEQ ID NO: 303 - DNA, 19 bp, Homo sapiens
agtcagatattgttgctca

SEQ ID NO: 304 - DNA, 19 bp, Homo sapiens
ggagggtagtcataacagt

SEQ ID NO: 305 - DNA, 19 bp, Homo sapiens
caaaagccgaaattccaat

SEQ ID NO: 306 - DNA, 19 bp, Homo sapiens
aaaagccgaaattccaatt

SEQ ID NO: 307 - DNA, 19 bp, Homo sapiens
ttcaagcaagaacttaatg

SEQ ID NO: 308 - DNA, 19 bp, Homo sapiens
cctcttacttttccattga

SEQ ID NO: 309 - DNA, 19 bp, Homo sapiens
tgaggccaacacttacttg

SEQ ID NO: 310 - DNA, 19 bp, Homo sapiens
cacttacttgaattccaag

SEQ ID NO: 311 - DNA, 19 bp, Homo sapiens
gaagtaaaagaaaattttg

SEQ ID NO: 312 - DNA, 19 bp, Homo sapiens
cctggaactctctccatgg

SEQ ID NO: 313 - DNA, 19 bp, Homo sapiens
agctggatgtaaccaccag

SEQ ID NO: 314 - DNA, 19 bp, Homo sapiens
aaaattccctgaagttgat

SEQ ID NO: 315 - DNA, 19 bp, Homo sapiens
cagatggcattgctgcttt

SEQ ID NO: 316 - DNA, 19 bp, Homo sapiens
agatggcattgctgctttg

SEQ ID NO: 317 - DNA, 19 bp, Homo sapiens
tgttgaaacagtcctggat

SEQ ID NO: 318 - DNA, 19 bp, Homo sapiens
catattcaaaactgagttg

SEQ ID NO: 319 - DNA, 19 bp, Homo sapiens
aaagatttatcaaaagaag

SEQ ID NO: 320 - DNA, 19 bp, Homo sapiens
attttccaactaatagaag

SEQ ID NO: 321 - DNA, 19 bp, Homo sapiens
aattatatccaagatgaga

SEQ ID NO: 322 - DNA, 19 bp, Homo sapiens
ttcaggaagcttctcaaga

SEQ ID NO: 323 - DNA, 19 bp, Homo sapiens
ttgagcaatttctgcacag

SEQ ID NO: 324 - DNA, 19 bp, Homo sapiens
ctgatatacatcacggagt

SEQ ID NO: 325 - DNA, 19 bp, Homo sapiens
acatcacggagttactgaa

SEQ ID NO: 326 - DNA, 19 bp, Homo sapiens
actgcctatattgataaaa

SEQ ID NO: 327 - DNA, 19 bp, Homo sapiens
aggatggcattttttgcaa

SEQ ID NO: 328 - DNA, 19 bp, Homo sapiens
ttttttgcaagttaaagaa

SEQ ID NO: 329 - DNA, 19 bp, Homo sapiens
tccagaactcaagtcttca

SEQ ID NO: 330 - DNA, 19 bp, Homo sapiens
agttagtgaaagaagttct

SEQ ID NO: 331 - DNA, 19 bp, Homo sapiens
atttacagctctgacaagt

SEQ ID NO: 332 - DNA, 19 bp, Homo sapiens
gattatctgaattcattca

SEQ ID NO: 333 - DNA, 19 bp, Homo sapiens
gtgcccttctcggttgctg

SEQ ID NO: 334 - DNA, 19 bp, Homo sapiens
attcaagcacctccggaag

SEQ ID NO: 335 - DNA, 19 bp, Homo sapiens
gactgctgattcaagaagt

SEQ ID NO: 336 - DNA, 19 bp, Homo sapiens
ttgctgcagccatgtccag

SEQ ID NO: 337 - DNA, 19 bp, Homo sapiens
agaaagatgaacctactta

SEQ ID NO: 338 - DNA, 19 bp, Homo sapiens
tgaagactctccaggaact

SEQ ID NO: 339 - DNA, 19 bp, Homo sapiens
atctctcttgccacagctg

SEQ ID NO: 340 - DNA, 19 bp, Homo sapiens
tctctcttgccacagctga

SEQ ID NO: 341 - DNA, 19 bp, Homo sapiens
tgaggtgtccagccccatc

SEQ ID NO: 342 - DNA, 19 bp, Homo sapiens
ccagaactcaagtcttcaa

SEQ ID NO: 343 - DNA, 19 bp, Homo sapiens
ctgaaaaagttagtgaaag

SEQ ID NO: 344 - DNA, 19 bp, Homo sapiens
tttttcccagacagtgtca

SEQ ID NO: 345 - DNA, 19 bp, Homo sapiens
ttttcccagacagtgtcaa

SEQ ID NO: 346 - DNA, 19 bp, Homo sapiens
cattcagaacaagaaaatt

SEQ ID NO: 347 - DNA, 19 bp, Homo sapiens
tgaagagaagattgaattt

SEQ ID NO: 348 - DNA, 19 bp, Homo sapiens
tttgaatggaacacaggca

SEQ ID NO: 349 - DNA, 19 bp, Homo sapiens
ttctagattcgaatatcaa

SEQ ID NO: 350 - DNA, 19 bp, Homo sapiens
gattcgaatatcaaattca

SEQ ID NO: 351 - DNA, 19 bp, Homo sapiens
tgcaacgaccaacttgaag

SEQ ID NO: 352 - DNA, 19 bp, Homo sapiens
ttaagctctcaaatgacat

SEQ ID NO: 353 - DNA, 19 bp, Homo sapiens
caatttaacaacaatgaat

SEQ ID NO: 354 - DNA, 19 bp, Homo sapiens
tgaatacagccaggacttg

SEQ ID NO: 355 - DNA, 19 bp, Homo sapiens
catcaatattgatcaattt

SEQ ID NO: 356 - DNA, 19 bp, Homo sapiens
ttgagcatgtcaaacactt

SEQ ID NO: 357 - DNA, 19 bp, Homo sapiens
tgaaggagactattcagaa

SEQ ID NO: 358 - DNA, 19 bp, Homo sapiens
ttcaggctcttcagaaagc

SEQ ID NO: 359 - DNA, 19 bp, Homo sapiens
tccacaaattgaacatccc

SEQ ID NO: 360 - DNA, 19 bp, Homo sapiens
tgaataccaatgctgaact

SEQ ID NO: 361 - DNA, 19 bp, Homo sapiens
taaactaatagatgtaatc

SEQ ID NO: 362 - DNA, 19 bp, Homo sapiens
ttgacctgtccattcaaaa

SEQ ID NO: 363 - DNA, 19 bp, Homo sapiens
gggctgagtgcccttctcg

SEQ ID NO: 364 - DNA, 19 bp, Homo sapiens
ggctgagtgcccttctcgg

SEQ ID NO: 365 - DNA, 19 bp, Homo sapiens
ctgagtgcccttctcggtt

SEQ ID NO: 366 - DNA, 19 bp, Homo sapiens
tctcggttgctgccgctga

SEQ ID NO: 367 - DNA, 19 bp, Homo sapiens
caggccgcagcccaggagc

SEQ ID NO: 368 - DNA, 19 bp, Homo sapiens
gctggcgctgcctgcgctg

SEQ ID NO: 369 - DNA, 19 bp, Homo sapiens
tgctgctggcgggcgccag

SEQ ID NO: 370 - DNA, 19 bp, Homo sapiens
ctggtctgtccaaaagatg

SEQ ID NO: 371 - DNA, 19 bp, Homo sapiens
ctgagagttccagtggagt

SEQ ID NO: 372 - DNA, 19 bp, Homo sapiens
tccagtggagtccctggga

SEQ ID NO: 373 - DNA, 19 bp, Homo sapiens
aggttgagctggaggttcc

SEQ ID NO: 374 - DNA, 19 bp, Homo sapiens
tgagctggaggttccccag

SEQ ID NO: 375 - DNA, 19 bp, Homo sapiens
tctgcagcttcatcctgaa

SEQ ID NO: 376 - DNA, 19 bp, Homo sapiens
gccagtgcaccctgaaaga

SEQ ID NO: 377 - DNA, 19 bp, Homo sapiens
ctctgaggagtttgctgca

SEQ ID NO: 378 - DNA, 19 bp, Homo sapiens
aggtatgagctcaagctgg

SEQ ID NO: 379 - DNA, 19 bp, Homo sapiens
tcctttacccggagaaaga

SEQ ID NO: 380 - DNA, 19 bp, Homo sapiens
catcaagaggggcatcatt

SEQ ID NO: 381 - DNA, 19 bp, Homo sapiens
tcctggttcccccagagac

SEQ ID NO: 382 - DNA, 19 bp, Homo sapiens
aagaagccaagcaagtgtt

SEQ ID NO: 383 - DNA, 19 bp, Homo sapiens
aagcaagtgttgtttctgg

SEQ ID NO: 384 - DNA, 19 bp, Homo sapiens
tctggataccgtgtatgga

SEQ ID NO: 385 - DNA, 19 bp, Homo sapiens
ccactcactttaccgtcaa

SEQ ID NO: 386 - DNA, 19 bp, Homo sapiens
aggaagggcaatgtggcaa

SEQ ID NO: 387 - DNA, 19 bp, Homo sapiens
gcaatgtggcaacagaaat

SEQ ID NO: 388 - DNA, 19 bp, Homo sapiens
caatgtggcaacagaaata

SEQ ID NO: 389 - DNA, 19 bp, Homo sapiens
tggcaacagaaatatccac

SEQ ID NO: 390 - DNA, 19 bp, Homo sapiens
agagacctgggccagtgtg

SEQ ID NO: 391 - DNA, 19 bp, Homo sapiens
tgtgatcgcttcaagccca

SEQ ID NO: 392 - DNA, 19 bp, Homo sapiens
gtgatcgcttcaagcccat

SEQ ID NO: 393 - DNA, 19 bp, Homo sapiens
cagcccacttgctctcatc

SEQ ID NO: 394 - DNA, 19 bp, Homo sapiens
gctctcatcaaaggcatga

SEQ ID NO: 395 - DNA, 19 bp, Homo sapiens
ccttgtcaactctgatcag

SEQ ID NO: 396 - DNA, 19 bp, Homo sapiens
cttgtcaactctgatcagc

SEQ ID NO: 397 - DNA, 19 bp, Homo sapiens
agccatctgcaaggagcaa

SEQ ID NO: 398 - DNA, 19 bp, Homo sapiens
gccatctgcaaggagcaac

SEQ ID NO: 399 - DNA, 19 bp, Homo sapiens
cttcctgcctttctcctac

SEQ ID NO: 400 - DNA, 19 bp, Homo sapiens
ctttctcctacaagaataa

SEQ ID NO: 401 - DNA, 19 bp, Homo sapiens
gatcaacagccgcttcttt

SEQ ID NO: 402 - DNA, 19 bp, Homo sapiens
atcaacagccgcttctttg

SEQ ID NO: 403 - DNA, 19 bp, Homo sapiens
acagccgcttctttggtga

SEQ ID NO: 404 - DNA, 19 bp, Homo sapiens
aagatgggcctcgcatttg

SEQ ID NO: 405 - DNA, 19 bp, Homo sapiens
tgttttgaagactctccag

SEQ ID NO: 406 - DNA, 19 bp, Homo sapiens
ttgaagactctccaggaac

SEQ ID NO: 407 - DNA, 19 bp, Homo sapiens
aactgaaaaaactaaccat

SEQ ID NO: 408 - DNA, 19 bp, Homo sapiens
ctgaaaaaactaaccatct

SEQ ID NO: 409 - DNA, 19 bp, Homo sapiens
aaaactaaccatctctgag

SEQ ID NO: 410 - DNA, 19 bp, Homo sapiens
tgagcaaaatatccagaga

SEQ ID NO: 411 - DNA, 19 bp, Homo sapiens
caataagctggttactgag

SEQ ID NO: 412 - DNA, 19 bp, Homo sapiens
tactgagctgagaggcctc

SEQ ID NO: 413 - DNA, 19 bp, Homo sapiens
gcctcagtgatgaagcagt

SEQ ID NO: 414 - DNA, 19 bp, Homo sapiens
agtcacatctctcttgcca

SEQ ID NO: 415 - DNA, 19 bp, Homo sapiens
atctctcttgccacagctg

SEQ ID NO: 416 - DNA, 19 bp, Homo sapiens
tctctcttgccacagctga

SEQ ID NO: 417 - DNA, 19 bp, Homo sapiens
tgccacagctgattgaggt

SEQ ID NO: 418 - DNA, 19 bp, Homo sapiens
gccacagctgattgaggtg

SEQ ID NO: 419 - DNA, 19 bp, Homo sapiens
tcactttacaagccttggt

SEQ ID NO: 420 - DNA, 19 bp, Homo sapiens
cccttctgatagatgtggt

SEQ ID NO: 421 - DNA, 19 bp, Homo sapiens
gtcacctacctggtggccc

SEQ ID NO: 422 - DNA, 19 bp, Homo sapiens
ccttgtatgcgctgagcca

SEQ ID NO: 423 - DNA, 19 bp, Homo sapiens
gacaaaccctacagggacc

SEQ ID NO: 424 - DNA, 19 bp, Homo sapiens
tgctaattacctgatggaa

SEQ ID NO: 425 - DNA, 19 bp, Homo sapiens
tgactgcactggggatgaa

SEQ ID NO: 426 - DNA, 19 bp, Homo sapiens
actgcactggggatgaaga

SEQ ID NO: 427 - DNA, 19 bp, Homo sapiens
atgaagattacacctattt

SEQ ID NO: 428 - DNA, 19 bp, Homo sapiens
accatggagcagttaactc

SEQ ID NO: 429 - DNA, 19 bp, Homo sapiens
gcagttaactccagaactc

SEQ ID NO: 430 - DNA, 19 bp, Homo sapiens
cagaactcaagtcttcaat

SEQ ID NO: 431 - DNA, 19 bp, Homo sapiens
caggctctgcggaaaatgg

SEQ ID NO: 432 - DNA, 19 bp, Homo sapiens
ccaggaggttcttcttcag

SEQ ID NO: 433 - DNA, 19 bp, Homo sapiens
ggttcttcttcagactttc

SEQ ID NO: 434 - DNA, 19 bp, Homo sapiens
tttccttgatgatgcttct

SEQ ID NO: 435 - DNA, 19 bp, Homo sapiens
ggagataagcgactggctg

SEQ ID NO: 436 - DNA, 19 bp, Homo sapiens
gctgcctatcttatgttga

SEQ ID NO: 437 - DNA, 19 bp, Homo sapiens
actttgtggcttcccatat

SEQ ID NO: 438 - DNA, 19 bp, Homo sapiens
gccaatatcttgaactcag

SEQ ID NO: 439 - DNA, 19 bp, Homo sapiens
aatatcttgaactcagaag

SEQ ID NO: 440 - DNA, 19 bp, Homo sapiens
ctcagaagaattggatatc

SEQ ID NO: 441 - DNA, 19 bp, Homo sapiens
aagaattggatatccaaga

SEQ ID NO: 442 - DNA, 19 bp, Homo sapiens
agaattggatatccaagat

SEQ ID NO: 443 - DNA, 19 bp, Homo sapiens
tggatatccaagatctgaa

SEQ ID NO: 444 - DNA, 19 bp, Homo sapiens
atatccaagatctgaaaaa

SEQ ID NO: 445 - DNA, 19 bp, Homo sapiens
tatccaagatctgaaaaag

SEQ ID NO: 446 - DNA, 19 bp, Homo sapiens
caagatctgaaaaagttag

SEQ ID NO: 447 - DNA, 19 bp, Homo sapiens
aagatctgaaaaagttagt

SEQ ID NO: 448 - DNA, 19 bp, Homo sapiens
tgaaaaagttagtgaaaga

SEQ ID NO: 449 - DNA, 19 bp, Homo sapiens
tccaactgtcatggacttc

SEQ ID NO: 450 - DNA, 19 bp, Homo sapiens
tcagaaaattctctcggaa

SEQ ID NO: 451 - DNA, 19 bp, Homo sapiens
ttccatcacttgacccagc

SEQ ID NO: 452 - DNA, 19 bp, Homo sapiens
cccagcctcagccaaaata

SEQ ID NO: 453 - DNA, 19 bp, Homo sapiens
agcctcagccaaaatagaa

SEQ ID NO: 454 - DNA, 19 bp, Homo sapiens
atcttatatttgatccaaa

SEQ ID NO: 455 - DNA, 19 bp, Homo sapiens
tcttatatttgatccaaat

SEQ ID NO: 456 - DNA, 19 bp, Homo sapiens
cttcctaaagaaagcatgc

SEQ ID NO: 457 - DNA, 19 bp, Homo sapiens
ctaaagaaagcatgctgaa

SEQ ID NO: 458 - DNA, 19 bp, Homo sapiens
taaagaaagcatgctgaaa

SEQ ID NO: 459 - DNA, 19 bp, Homo sapiens
gagattggcttggaaggaa

SEQ ID NO: 460 - DNA, 19 bp, Homo sapiens
ctttgagccaacattggaa

SEQ ID NO: 461 - DNA, 19 bp, Homo sapiens
cagacagtgtcaacaaagc

SEQ ID NO: 462 - DNA, 19 bp, Homo sapiens
cagtgtcaacaaagctttg

SEQ ID NO: 463 - DNA, 19 bp, Homo sapiens
agtgtcaacaaagctttgt

SEQ ID NO: 464 - DNA, 19 bp, Homo sapiens
ctgatggtgtctctaaggt

SEQ ID NO: 465 - DNA, 19 bp, Homo sapiens
tgatggtgtctctaaggtc

SEQ ID NO: 466 - DNA, 19 bp, Homo sapiens
aaacatgagcaggatatgg

SEQ ID NO: 467 - DNA, 19 bp, Homo sapiens
gaagctgattaaagatttg

SEQ ID NO: 468 - DNA, 19 bp, Homo sapiens
aaagatttgaaatccaaag

SEQ ID NO: 469 - DNA, 19 bp, Homo sapiens
gatgggtgcccgcactctg

SEQ ID NO: 470 - DNA, 19 bp, Homo sapiens
gggatcccccagatgattg

SEQ ID NO: 471 - DNA, 19 bp, Homo sapiens
ttttcttcactacatcttc

SEQ ID NO: 472 - DNA, 19 bp, Homo sapiens
tcttcactacatcttcatg

SEQ ID NO: 473 - DNA, 19 bp, Homo sapiens
tacatcttcatggagaatg

SEQ ID NO: 474 - DNA, 19 bp, Homo sapiens
ttcatggagaatgcctttg

SEQ ID NO: 475 - DNA, 19 bp, Homo sapiens
tcatggagaatgcctttga

SEQ ID NO: 476 - DNA, 19 bp, Homo sapiens
tttgaactccccactggag

SEQ ID NO: 477 - DNA, 19 bp, Homo sapiens
ttgaactccccactggagc

SEQ ID NO: 478 - DNA, 19 bp, Homo sapiens
tgaactccccactggagct

SEQ ID NO: 479 - DNA, 19 bp, Homo sapiens
cactggagctggattacag

SEQ ID NO: 480 - DNA, 19 bp, Homo sapiens
actggagctggattacagt

SEQ ID NO: 481 - DNA, 19 bp, Homo sapiens
agttgcaaatatcttcatc

SEQ ID NO: 482 - DNA, 19 bp, Homo sapiens
gttgcaaatatcttcatct

SEQ ID NO: 483 - DNA, 19 bp, Homo sapiens
aaatatcttcatctggagt

SEQ ID NO: 484 - DNA, 19 bp, Homo sapiens
taaaactggaagtagccaa

SEQ ID NO: 485 - DNA, 19 bp, Homo sapiens
ggctgaactggtggcaaaa

SEQ ID NO: 486 - DNA, 19 bp, Homo sapiens
tgtggagtttgtgacaaat

SEQ ID NO: 487 - DNA, 19 bp, Homo sapiens
ttgtgacaaatatgggcat

SEQ ID NO: 488 - DNA, 19 bp, Homo sapiens
atgaacaccaacttcttcc

SEQ ID NO: 489 - DNA, 19 bp, Homo sapiens
cttccacgagtcgggtctg

SEQ ID NO: 490 - DNA, 19 bp, Homo sapiens
gagtcgggtctggaggctc

SEQ ID NO: 491 - DNA, 19 bp, Homo sapiens
cctaaaagctgggaagctg

SEQ ID NO: 492 - DNA, 19 bp, Homo sapiens
agctgggaagctgaagttt

SEQ ID NO: 493 - DNA, 19 bp, Homo sapiens
ccagattagagctggaact

SEQ ID NO: 494 - DNA, 19 bp, Homo sapiens
ggataccctgaagtttgta

SEQ ID NO: 495 - DNA, 19 bp, Homo sapiens
ctgaggctaccatgacatt

SEQ ID NO: 496 - DNA, 19 bp, Homo sapiens
tgtccagtgaagtccaaat

SEQ ID NO: 497 - DNA, 19 bp, Homo sapiens
aattccggattttgatgtt

SEQ ID NO: 498 - DNA, 19 bp, Homo sapiens
ttccggattttgatgttga

SEQ ID NO: 499 - DNA, 19 bp, Homo sapiens
cggaacaatcctcagagtt

SEQ ID NO: 500 - DNA, 19 bp, Homo sapiens
tcctcagagttaatgatga

SEQ ID NO: 501 - DNA, 19 bp, Homo sapiens
ctcaccctggacattcaga

SEQ ID NO: 502 - DNA, 19 bp, Homo sapiens
cattcagaacaagaaaatt

SEQ ID NO: 503 - DNA, 19 bp, Homo sapiens
actgaggtcgccctcatgg

SEQ ID NO: 504 - DNA, 19 bp, Homo sapiens
ttatttccataccccgttt

SEQ ID NO: 505 - DNA, 19 bp, Homo sapiens
gtttgcaagcagaagccag

SEQ ID NO: 506 - DNA, 19 bp, Homo sapiens
tttgcaagcagaagccaga

SEQ ID NO: 507 - DNA, 19 bp, Homo sapiens
ttgcaagcagaagccagaa

SEQ ID NO: 508 - DNA, 19 bp, Homo sapiens
ctgcttctccaaatggact

SEQ ID NO: 509 - DNA, 19 bp, Homo sapiens
tgctacagcttatggctcc

SEQ ID NO: 510 - DNA, 19 bp, Homo sapiens
acagcttatggctccacag

SEQ ID NO: 511 - DNA, 19 bp, Homo sapiens
tttccaagagggtggcatg

SEQ ID NO: 512 - DNA, 19 bp, Homo sapiens
ccaagagggtggcatggca

SEQ ID NO: 513 - DNA, 19 bp, Homo sapiens
gtggcatggcattatgatg

SEQ ID NO: 514 - DNA, 19 bp, Homo sapiens
tgatgaagagaagattgaa

SEQ ID NO: 515 - DNA, 19 bp, Homo sapiens
gaagagaagattgaatttg

SEQ ID NO: 516 - DNA, 19 bp, Homo sapiens
gagaagattgaatttgaat

SEQ ID NO: 517 - DNA, 19 bp, Homo sapiens
tttgaatggaacacaggca

SEQ ID NO: 518 - DNA, 19 bp, Homo sapiens
aggcaccaatgtagatacc

SEQ ID NO: 519 - DNA, 19 bp, Homo sapiens
caaaaaaatgacttccaat

SEQ ID NO: 520 - DNA, 19 bp, Homo sapiens
aaaaaaatgacttccaatt

SEQ ID NO: 521 - DNA, 19 bp, Homo sapiens
aaaaaatgacttccaattt

SEQ ID NO: 522 - DNA, 19 bp, Homo sapiens
cagagtccctcaaacagac

SEQ ID NO: 523 - DNA, 19 bp, Homo sapiens
aaattaatagttgcaatga

SEQ ID NO: 524 - DNA, 19 bp, Homo sapiens
ttcaacctccagaacatgg

SEQ ID NO: 525 - DNA, 19 bp, Homo sapiens
tgggattgccagacttcca

SEQ ID NO: 526 - DNA, 19 bp, Homo sapiens
cagtttgaaaattgagatt

SEQ ID NO: 527 - DNA, 19 bp, Homo sapiens
gaaaattgagattcctttg

SEQ ID NO: 528 - DNA, 19 bp, Homo sapiens
tttgccttttggtggcaaa

SEQ ID NO: 529 - DNA, 19 bp, Homo sapiens
ctccagagatctaaagatg

SEQ ID NO: 530 - DNA, 19 bp, Homo sapiens
tctaaagatgttagagact

SEQ ID NO: 531 - DNA, 19 bp, Homo sapiens
ctgtgggattccatctgcc

SEQ ID NO: 532 - DNA, 19 bp, Homo sapiens
atctgccatctcgagagtt

SEQ ID NO: 533 - DNA, 19 bp, Homo sapiens
tctcgagagttccaagtcc

SEQ ID NO: 534 - DNA, 19 bp, Homo sapiens
agtccctacttttaccatt

SEQ ID NO: 535 - DNA, 19 bp, Homo sapiens
acttttaccattcccaagt

SEQ ID NO: 536 - DNA, 19 bp, Homo sapiens
cattcccaagttgtatcaa

SEQ ID NO: 537 - DNA, 19 bp, Homo sapiens
accacatgaaggctgactc

SEQ ID NO: 538 - DNA, 19 bp, Homo sapiens
tttcctacaatgtgcaagg

SEQ ID NO: 539 - DNA, 19 bp, Homo sapiens
ctggagaaacaacatatga

SEQ ID NO: 540 - DNA, 19 bp, Homo sapiens
atcatgtgatgggtctcta

SEQ ID NO: 541 - DNA, 19 bp, Homo sapiens
catgtgatgggtctctacg

SEQ ID NO: 542 - DNA, 19 bp, Homo sapiens
ttctagattcgaatatcaa

SEQ ID NO: 543 - DNA, 19 bp, Homo sapiens
tggggaccacagatgtctg

SEQ ID NO: 544 - DNA, 19 bp, Homo sapiens
ctaacactggccggctcaa

SEQ ID NO: 545 - DNA, 19 bp, Homo sapiens
taacactggccggctcaat

SEQ ID NO: 546 - DNA, 19 bp, Homo sapiens
aacactggccggctcaatg

SEQ ID NO: 547 - DNA, 19 bp, Homo sapiens
ctggccggctcaatggaga

SEQ ID NO: 548 - DNA, 19 bp, Homo sapiens
agataacaggaagatatga

SEQ ID NO: 549 - DNA, 19 bp, Homo sapiens
tccctcacctccacctctg

SEQ ID NO: 550 - DNA, 19 bp, Homo sapiens
agctgactttaaaatctga

SEQ ID NO: 551 - DNA, 19 bp, Homo sapiens
ctgactttaaaatctgaca

SEQ ID NO: 552 - DNA, 19 bp, Homo sapiens
caagatggatatgaccttc

SEQ ID NO: 553 - DNA, 19 bp, Homo sapiens
gctgcgttctgaatatcag

SEQ ID NO: 554 - DNA, 19 bp, Homo sapiens
cgttctgaatatcaggctg

SEQ ID NO: 555 - DNA, 19 bp, Homo sapiens
aattcccatggtcttgagt

SEQ ID NO: 556 - DNA, 19 bp, Homo sapiens
tggtcttgagttaaatgct

SEQ ID NO: 557 - DNA, 19 bp, Homo sapiens
cttgagttaaatgctgaca

SEQ ID NO: 558 - DNA, 19 bp, Homo sapiens
ttgagttaaatgctgacat

SEQ ID NO: 559 - DNA, 19 bp, Homo sapiens
tgagttaaatgctgacatc

SEQ ID NO: 560 - DNA, 19 bp, Homo sapiens
acttgaagtgtagtctcct

SEQ ID NO: 561 - DNA, 19 bp, Homo sapiens
agtgtagtctcctggtgct

SEQ ID NO: 562 - DNA, 19 bp, Homo sapiens
gtgctggagaatgagctga

SEQ ID NO: 563 - DNA, 19 bp, Homo sapiens
ctggggcatctatgaaatt

SEQ ID NO: 564 - DNA, 19 bp, Homo sapiens
atggccgcttcagggaaca

SEQ ID NO: 565 - DNA, 19 bp, Homo sapiens
ttcagtctggatgggaaag

SEQ ID NO: 566 - DNA, 19 bp, Homo sapiens
ccatgattctgggtgtcga

SEQ ID NO: 567 - DNA, 19 bp, Homo sapiens
aaaacattttcaacttcaa

SEQ ID NO: 568 - DNA, 19 bp, Homo sapiens
cttaagctctcaaatgaca

SEQ ID NO: 569 - DNA, 19 bp, Homo sapiens
ttaagctctcaaatgacat

SEQ ID NO: 570 - DNA, 19 bp, Homo sapiens
catgatgggctcatatgct

SEQ ID NO: 571 - DNA, 19 bp, Homo sapiens
tgggctcatatgctgaaat

SEQ ID NO: 572 - DNA, 19 bp, Homo sapiens
actggacttctcttcaaaa

SEQ ID NO: 573 - DNA, 19 bp, Homo sapiens
acttctcttcaaaacttga

SEQ ID NO: 574 - DNA, 19 bp, Homo sapiens
ctgacaagttttataagca

SEQ ID NO: 575 - DNA, 19 bp, Homo sapiens
aagttttataagcaaactg

SEQ ID NO: 576 - DNA, 19 bp, Homo sapiens
ctgttaatttacagctaca

SEQ ID NO: 577 - DNA, 19 bp, Homo sapiens
ttacagctacagccctatt

SEQ ID NO: 578 - DNA, 19 bp, Homo sapiens
tctggtaactactttaaac

SEQ ID NO: 579 - DNA, 19 bp, Homo sapiens
tttaaacagtgacctgaaa

SEQ ID NO: 580 - DNA, 19 bp, Homo sapiens
ttaaacagtgacctgaaat

SEQ ID NO: 581 - DNA, 19 bp, Homo sapiens
cagtgacctgaaatacaat

SEQ ID NO: 582 - DNA, 19 bp, Homo sapiens
tgtggctggtaacctaaaa

SEQ ID NO: 583 - DNA, 19 bp, Homo sapiens
ttatcagcaagctataaag

SEQ ID NO: 584 - DNA, 19 bp, Homo sapiens
ggttcagggtgtggagttt

SEQ ID NO: 585 - DNA, 19 bp, Homo sapiens
attcagactcactgcattt

SEQ ID NO: 586 - DNA, 19 bp, Homo sapiens
ttcagactcactgcatttc

SEQ ID NO: 587 - DNA, 19 bp, Homo sapiens
tacaaatggcaatgggaaa

SEQ ID NO: 588 - DNA, 19 bp, Homo sapiens
gctgtatagcaaattcctg

SEQ ID NO: 589 - DNA, 19 bp, Homo sapiens
tgagcagacaggcacctgg

SEQ ID NO: 590 - DNA, 19 bp, Homo sapiens
ggcacctggaaactcaaga

SEQ ID NO: 591 - DNA, 19 bp, Homo sapiens
tgaatacagccaggacttg

SEQ ID NO: 592 - DNA, 19 bp, Homo sapiens
gaatacagccaggacttgg

SEQ ID NO: 593 - DNA, 19 bp, Homo sapiens
ctggacgaactctggctga

SEQ ID NO: 594 - DNA, 19 bp, Homo sapiens
ttttactcagtgagcccat

SEQ ID NO: 595 - DNA, 19 bp, Homo sapiens
gatgagagatgccgttgag

SEQ ID NO: 596 - DNA, 19 bp, Homo sapiens
aattgttgcttttgtaaag

SEQ ID NO: 597 - DNA, 19 bp, Homo sapiens
cttttgtaaagtatgataa

SEQ ID NO: 598 - DNA, 19 bp, Homo sapiens
tttgtaaagtatgataaaa

SEQ ID NO: 599 - DNA, 19 bp, Homo sapiens
tccattaacctcccatttt

SEQ ID NO: 600 - DNA, 19 bp, Homo sapiens
ccattaacctcccattttt

SEQ ID NO: 601 - DNA, 19 bp, Homo sapiens
cttgcaagaatattttgag

SEQ ID NO: 602 - DNA, 19 bp, Homo sapiens
agaatattttgagaggaat

SEQ ID NO: 603 - DNA, 19 bp, Homo sapiens
attatagttgtactggaaa

SEQ ID NO: 604 - DNA, 19 bp, Homo sapiens
gaagcacatcaatattgat

SEQ ID NO: 605 - DNA, 19 bp, Homo sapiens
acatcaatattgatcaatt

SEQ ID NO: 606 - DNA, 19 bp, Homo sapiens
gaaaactcccacagcaagc

SEQ ID NO: 607 - DNA, 19 bp, Homo sapiens
ctgaattcattcaattggg

SEQ ID NO: 608 - DNA, 19 bp, Homo sapiens
tgaattcattcaattggga

SEQ ID NO: 609 - DNA, 19 bp, Homo sapiens
aactgactgctctcacaaa

SEQ ID NO: 610 - DNA, 19 bp, Homo sapiens
aaaagtatagaattacaga

SEQ ID NO: 611 - DNA, 19 bp, Homo sapiens
atcaactttaatgaaaaac

SEQ ID NO: 612 - DNA, 19 bp, Homo sapiens
tgatttgaaaatagctatt

SEQ ID NO: 613 - DNA, 19 bp, Homo sapiens
atttgaaaatagctattgc

SEQ ID NO: 614 - DNA, 19 bp, Homo sapiens
attgctaatattattgatg

SEQ ID NO: 615 - DNA, 19 bp, Homo sapiens
gaaaaattaaaaagtcttg

SEQ ID NO: 616 - DNA, 19 bp, Homo sapiens
actatcatatccgtgtaat

SEQ ID NO: 617 - DNA, 19 bp, Homo sapiens
tattgattttaacaaaagt

SEQ ID NO: 618 - DNA, 19 bp, Homo sapiens
ctgcagcagcttaagagac

SEQ ID NO: 619 - DNA, 19 bp, Homo sapiens
aaaacaacacattgaggct

SEQ ID NO: 620 - DNA, 19 bp, Homo sapiens
ttgagcatgtcaaacactt

SEQ ID NO: 621 - DNA, 19 bp, Homo sapiens
tttgaagtagctgagaaaa

SEQ ID NO: 622 - DNA, 19 bp, Homo sapiens
ttagtagagttggcccacc

SEQ ID NO: 623 - DNA, 19 bp, Homo sapiens
tgaaggagactattcagaa

SEQ ID NO: 624 - DNA, 19 bp, Homo sapiens
gagactattcagaagctaa

SEQ ID NO: 625 - DNA, 19 bp, Homo sapiens
aattagttggatttattga

SEQ ID NO: 626 - DNA, 19 bp, Homo sapiens
gcttaatgaattatctttt

SEQ ID NO: 627 - DNA, 19 bp, Homo sapiens
ttaacaaattccttgacat

SEQ ID NO: 628 - DNA, 19 bp, Homo sapiens
aaattaaagtcatttgatt

SEQ ID NO: 629 - DNA, 19 bp, Homo sapiens
gactcaatggtgaaattca

SEQ ID NO: 630 - DNA, 19 bp, Homo sapiens
gaaattcaggctctggaac

SEQ ID NO: 631 - DNA, 19 bp, Homo sapiens
actaccacaaaaagctgaa

SEQ ID NO: 632 - DNA, 19 bp, Homo sapiens
ccaaaataaccttaatcat

SEQ ID NO: 633 - DNA, 19 bp, Homo sapiens
aaataaccttaatcatcaa

SEQ ID NO: 634 - DNA, 19 bp, Homo sapiens
tttaagttcagcatctttg

SEQ ID NO: 635 - DNA, 19 bp, Homo sapiens
caggtttatagcacacttg

SEQ ID NO: 636 - DNA, 19 bp, Homo sapiens
gttcactgttcctgaaatc

SEQ ID NO: 637 - DNA, 19 bp, Homo sapiens
cactgttcctgaaatcaag

SEQ ID NO: 638 - DNA, 19 bp, Homo sapiens
actgttcctgaaatcaaga

SEQ ID NO: 639 - DNA, 19 bp, Homo sapiens
gcctgcctttgaagtcagt

SEQ ID NO: 640 - DNA, 19 bp, Homo sapiens
taacagatttgaggattcc

SEQ ID NO: 641 - DNA, 19 bp, Homo sapiens
gttttccacaccagaattt

SEQ ID NO: 642 - DNA, 19 bp, Homo sapiens
tcagaaccattgaccagat

SEQ ID NO: 643 - DNA, 19 bp, Homo sapiens
tagcgagaatcaccctgcc

SEQ ID NO: 644 - DNA, 19 bp, Homo sapiens
ccttaatgattttcaagtt

SEQ ID NO: 645 - DNA, 19 bp, Homo sapiens
acataccagaattccagct

SEQ ID NO: 646 - DNA, 19 bp, Homo sapiens
aatgctgacatagggaatg

SEQ ID NO: 647 - DNA, 19 bp, Homo sapiens
atgctgacatagggaatgg

SEQ ID NO: 648 - DNA, 19 bp, Homo sapiens
aaccacctcagcaaacgaa

SEQ ID NO: 649 - DNA, 19 bp, Homo sapiens
agcaggtatcgcagcttcc

SEQ ID NO: 650 - DNA, 19 bp, Homo sapiens
tgcacaactctcaaaccct

SEQ ID NO: 651 - DNA, 19 bp, Homo sapiens
aggagtcagtgaagttctc

SEQ ID NO: 652 - DNA, 19 bp, Homo sapiens
tttttggaaatgccattga

SEQ ID NO: 653 - DNA, 19 bp, Homo sapiens
aatggagtgattgtcaaga

SEQ ID NO: 654 - DNA, 19 bp, Homo sapiens
gtcaagataaacaatcagc

SEQ ID NO: 655 - DNA, 19 bp, Homo sapiens
tccacaaattgaacatccc

SEQ ID NO: 656 - DNA, 19 bp, Homo sapiens
ttgaacatccccaaactgg

SEQ ID NO: 657 - DNA, 19 bp, Homo sapiens
acatccccaaactggactt

SEQ ID NO: 658 - DNA, 19 bp, Homo sapiens
acttctctagtcaggctga

SEQ ID NO: 659 - DNA, 19 bp, Homo sapiens
tgaatcacaaattagtttc

SEQ ID NO: 660 - DNA, 19 bp, Homo sapiens
agaaggacccctcacttcc

SEQ ID NO: 661 - DNA, 19 bp, Homo sapiens
ttggactgtccaataagat

SEQ ID NO: 662 - DNA, 19 bp, Homo sapiens
actgtccaataagatcaat

SEQ ID NO: 663 - DNA, 19 bp, Homo sapiens
ctgtccaataagatcaata

SEQ ID NO: 664 - DNA, 19 bp, Homo sapiens
gtttatgaatctggctccc

SEQ ID NO: 665 - DNA, 19 bp, Homo sapiens
atgaatctggctccctcaa

SEQ ID NO: 666 - DNA, 19 bp, Homo sapiens
ctcaacttttctaaacttg

SEQ ID NO: 667 - DNA, 19 bp, Homo sapiens
ctaaaggcatggcactgtt

SEQ ID NO: 668 - DNA, 19 bp, Homo sapiens
aaggcatggcactgtttgg

SEQ ID NO: 669 - DNA, 19 bp, Homo sapiens
atccacaaacaatgaaggg

SEQ ID NO: 670 - DNA, 19 bp, Homo sapiens
ggaatttgaaagttcgttt

SEQ ID NO: 671 - DNA, 19 bp, Homo sapiens
aataactatgcactgtttc

SEQ ID NO: 672 - DNA, 19 bp, Homo sapiens
gaaacaacgagaacattat

SEQ ID NO: 673 - DNA, 19 bp, Homo sapiens
ttcttgaaaacgacaaagc

SEQ ID NO: 674 - DNA, 19 bp, Homo sapiens
ataagaaaaacaaacacag

SEQ ID NO: 675 - DNA, 19 bp, Homo sapiens
aaaacaaacacaggcattc

SEQ ID NO: 676 - DNA, 19 bp, Homo sapiens
gcattccatcacaaatcct

SEQ ID NO: 677 - DNA, 19 bp, Homo sapiens
tttgaaaaaaacagaaaca

SEQ ID NO: 678 - DNA, 19 bp, Homo sapiens
caatgcattagattttgtc

SEQ ID NO: 679 - DNA, 19 bp, Homo sapiens
caaagctgaaaaatctcag

SEQ ID NO: 680 - DNA, 19 bp, Homo sapiens
cctggatacactgttccag

SEQ ID NO: 681 - DNA, 19 bp, Homo sapiens
gttgaagtgtctccattca

SEQ ID NO: 682 - DNA, 19 bp, Homo sapiens
tttctccatcctaggttct

SEQ ID NO: 683 - DNA, 19 bp, Homo sapiens
ttctccatcctaggttctg

SEQ ID NO: 684 - DNA, 19 bp, Homo sapiens
tcattagagctgccagtcc

SEQ ID NO: 685 - DNA, 19 bp, Homo sapiens
tgctgaactttttaaccag

SEQ ID NO: 686 - DNA, 19 bp, Homo sapiens
ctcctttcttcatcttcat

SEQ ID NO: 687 - DNA, 19 bp, Homo sapiens
tgtcattgatgcactgcag

SEQ ID NO: 688 - DNA, 19 bp, Homo sapiens
tgatgcactgcagtacaaa

SEQ ID NO: 689 - DNA, 19 bp, Homo sapiens
agctctgtctctgagcaac

SEQ ID NO: 690 - DNA, 19 bp, Homo sapiens
agccgaaattccaattttg

SEQ ID NO: 691 - DNA, 19 bp, Homo sapiens
ttgagaatgaatttcaagc

SEQ ID NO: 692 - DNA, 19 bp, Homo sapiens
aaacctactgtctcttcct

SEQ ID NO: 693 - DNA, 19 bp, Homo sapiens
tacttttccattgagtcat

SEQ ID NO: 694 - DNA, 19 bp, Homo sapiens
tcaggtccatgcaagtcag

SEQ ID NO: 695 - DNA, 19 bp, Homo sapiens
atgcaagtcagcccagttc

SEQ ID NO: 696 - DNA, 19 bp, Homo sapiens
tgaatgctaacactaagaa

SEQ ID NO: 697 - DNA, 19 bp, Homo sapiens
agaagatcagatggaaaaa

SEQ ID NO: 698 - DNA, 19 bp, Homo sapiens
ggctattcattctccatcc

SEQ ID NO: 699 - DNA, 19 bp, Homo sapiens
aaagttttggctgataaat

SEQ ID NO: 700 - DNA, 19 bp, Homo sapiens
agttttggctgataaattc

SEQ ID NO: 701 - DNA, 19 bp, Homo sapiens
ctgggctgaaactaaatga

SEQ ID NO: 702 - DNA, 19 bp, Homo sapiens
cagagaaatacaaatctat

SEQ ID NO: 703 - DNA, 19 bp, Homo sapiens
gaggtaaaattccctgaag

SEQ ID NO: 704 - DNA, 19 bp, Homo sapiens
cttttttgagataaccgtg

SEQ ID NO: 705 - DNA, 19 bp, Homo sapiens
gctggaattgtcattcctt

SEQ ID NO: 706 - DNA, 19 bp, Homo sapiens
gtgtataatgccacttgga

SEQ ID NO: 707 - DNA, 19 bp, Homo sapiens
attccacatgcagctcaac

SEQ ID NO: 708 - DNA, 19 bp, Homo sapiens
tgaagaagatggcaaattt

SEQ ID NO: 709 - DNA, 19 bp, Homo sapiens
atcaaaagcccagcgttca

SEQ ID NO: 710 - DNA, 19 bp, Homo sapiens
gtgggcatggatatggatg

SEQ ID NO: 711 - DNA, 19 bp, Homo sapiens
aaatggaacttctactaca

SEQ ID NO: 712 - DNA, 19 bp, Homo sapiens
aaaaactcaccatattcaa

SEQ ID NO: 713 - DNA, 19 bp, Homo sapiens
ctgagaagaaatctgcaga

SEQ ID NO: 714 - DNA, 19 bp, Homo sapiens
acaatgctgagtgggttta

SEQ ID NO: 715 - DNA, 19 bp, Homo sapiens
caatgctgagtgggtttat

SEQ ID NO: 716 - DNA, 19 bp, Homo sapiens
ttaggcaaattgatgatat

SEQ ID NO: 717 - DNA, 19 bp, Homo sapiens
ataaactaatagatgtaat

SEQ ID NO: 718 - DNA, 19 bp, Homo sapiens
ccaactaatagaagataac

SEQ ID NO: 719 - DNA, 19 bp, Homo sapiens
ttaattatatccaagatga

SEQ ID NO: 720 - DNA, 19 bp, Homo sapiens
tttaaattgttgaaagaaa

SEQ ID NO: 721 - DNA, 19 bp, Homo sapiens
aagttcaatgaatttattc

SEQ ID NO: 722 - DNA, 19 bp, Homo sapiens
ttgaagaaaagatagtcag

SEQ ID NO: 723 - DNA, 19 bp, Homo sapiens
acttccattctgaatatat

SEQ ID NO: 724 - DNA, 19 bp, Homo sapiens
cacagaaatattcaggaat

SEQ ID NO: 725 - DNA, 19 bp, Homo sapiens
ccattgcgacgaagaaaat

SEQ ID NO: 726 - DNA, 19 bp, Homo sapiens
tataaactgcaagattttt

SEQ ID NO: 727 - DNA, 19 bp, Homo sapiens
tctgattactatgaaaaat

SEQ ID NO: 728 - DNA, 19 bp, Homo sapiens
ggagttactgaaaaagctg

SEQ ID NO: 729 - DNA, 19 bp, Homo sapiens
tgaagcttgctccaggaga

SEQ ID NO: 730 - DNA, 19 bp, Homo sapiens
tgaactggacctgcaccaa

SEQ ID NO: 731 - DNA, 19 bp, Homo sapiens
ttgctaaacttgggggagg

SEQ ID NO: 732 - DNA, 19 bp, Homo sapiens
gattcgaatatcaaattca

SEQ ID NO: 733 - DNA, 19 bp, Homo sapiens
atttgtttgtcaaagaagt

SEQ ID NO: 734 - DNA, 19 bp, Homo sapiens
tctcggttgctgccgctga

SEQ ID NO: 735 - DNA, 19 bp, Homo sapiens
gctgaggagcccgcccagc

SEQ ID NO: 736 - DNA, 19 bp, Homo sapiens
ctggtctgtccaaaagatg

SEQ ID NO: 737 - DNA, 19 bp, Homo sapiens
ctgagagttccagtggagt

SEQ ID NO: 738 - DNA, 19 bp, Homo sapiens
cagtgcaccctgaaagagg

SEQ ID NO: 739 - DNA, 19 bp, Homo sapiens
ctctgaggagtttgctgca

SEQ ID NO: 740 - DNA, 19 bp, Homo sapiens
acatcaagaggggcatcat

SEQ ID NO: 741 - DNA, 19 bp, Homo sapiens
ctgatcagcagcagccagt

SEQ ID NO: 742 - DNA, 19 bp, Homo sapiens
ggacgctaagaggaagcat

SEQ ID NO: 743 - DNA, 19 bp, Homo sapiens
agctgttttgaagactctc

SEQ ID NO: 744 - DNA, 19 bp, Homo sapiens
tgaaaaaactaaccatctc

SEQ ID NO: 745 - DNA, 19 bp, Homo sapiens
ctgagctgagaggcctcag

SEQ ID NO: 746 - DNA, 19 bp, Homo sapiens
tgaaacgtgtgcatgccaa

SEQ ID NO: 747 - DNA, 19 bp, Homo sapiens
ccttgtatgcgctgagcca

SEQ ID NO: 748 - DNA, 19 bp, Homo sapiens
aggagctgctggacattgc

SEQ ID NO: 749 - DNA, 19 bp, Homo sapiens
atttgattctgcgggtcat

SEQ ID NO: 750 - DNA, 19 bp, Homo sapiens
tccagaactcaagtcttca

SEQ ID NO: 751 - DNA, 19 bp, Homo sapiens
ggttcttcttcagactttc

SEQ ID NO: 752 - DNA, 19 bp, Homo sapiens
gttgatgaggagtccttca

SEQ ID NO: 753 - DNA, 19 bp, Homo sapiens
tccaagatctgaaaaagtt

SEQ ID NO: 754 - DNA, 19 bp, Homo sapiens
agttagtgaaagaagttct

SEQ ID NO: 755 - DNA, 19 bp, Homo sapiens
gaagggaatcttatatttg

SEQ ID NO: 756 - DNA, 19 bp, Homo sapiens
ggaagctctttttgggaag

SEQ ID NO: 757 - DNA, 19 bp, Homo sapiens
tggaataatgctcagtgtt

SEQ ID NO: 758 - DNA, 19 bp, Homo sapiens
gatttgaaatccaaagaag

SEQ ID NO: 759 - DNA, 19 bp, Homo sapiens
tccaaagaagtcccggaag

SEQ ID NO: 760 - DNA, 19 bp, Homo sapiens
aggaagggctcaaagaatg

SEQ ID NO: 761 - DNA, 19 bp, Homo sapiens
agaatgacttttttcttca

SEQ ID NO: 762 - DNA, 19 bp, Homo sapiens
tttgtgacaaatatgggca

SEQ ID NO: 763 - DNA, 19 bp, Homo sapiens
ctgaggctaccatgacatt

SEQ ID NO: 764 - DNA, 19 bp, Homo sapiens
gtagataccaaaaaaatga

SEQ ID NO: 765 - DNA, 19 bp, Homo sapiens
aaatgacttccaatttccc

SEQ ID NO: 766 - DNA, 19 bp, Homo sapiens
atgacttccaatttccctg

SEQ ID NO: 767 - DNA, 19 bp, Homo sapiens
atctgccatctcgagagtt

SEQ ID NO: 768 - DNA, 19 bp, Homo sapiens
atttgtttgtcaaagaagt

SEQ ID NO: 769 - DNA, 19 bp, Homo sapiens
gcagagcttggcctctctg

SEQ ID NO: 770 - DNA, 19 bp, Homo sapiens
atatgctgaaatgaaattt

SEQ ID NO: 771 - DNA, 19 bp, Homo sapiens
tcaaaacttgacaacattt

SEQ ID NO: 772 - DNA, 19 bp, Homo sapiens
cagtgacctgaaatacaat

SEQ ID NO: 773 - DNA, 19 bp, Homo sapiens
tacaaatggcaatgggaaa

SEQ ID NO: 774 - DNA, 19 bp, Homo sapiens
cttttgtaaagtatgataa

SEQ ID NO: 775 - DNA, 19 bp, Homo sapiens
ttgtaaagtatgataaaaa

SEQ ID NO: 776 - DNA, 19 bp, Homo sapiens
tccattaacctcccatttt

SEQ ID NO: 777 - DNA, 19 bp, Homo sapiens
gattatctgaattcattca

SEQ ID NO: 778 - DNA, 19 bp, Homo sapiens
aattgggagagacaagttt

SEQ ID NO: 779 - DNA, 19 bp, Homo sapiens
atttgaaaatagctattgc

SEQ ID NO: 780 - DNA, 19 bp, Homo sapiens
tgagcatgtcaaacacttt

SEQ ID NO: 781 - DNA, 19 bp, Homo sapiens
ttgaagatgttaacaaatt

SEQ ID NO: 782 - DNA, 19 bp, Homo sapiens
acttgtcacctacatttct

SEQ ID NO: 783 - DNA, 19 bp, Homo sapiens
gttttccacaccagaattt

SEQ ID NO: 784 - DNA, 19 bp, Homo sapiens
ataagtacaaccaaaattt

SEQ ID NO: 785 - DNA, 19 bp, Homo sapiens
cgggacctgcggggctgag

SEQ ID NO: 786 - DNA, 19 bp, Homo sapiens
agtgcccttctcggttgct

SEQ ID NO: 787 - DNA, 19 bp, Homo sapiens
gctgaggagcccgcccagc

SEQ ID NO: 788 - DNA, 19 bp, Homo sapiens
gaggagcccgcccagccag

SEQ ID NO: 789 - DNA, 19 bp, Homo sapiens
gggccgcgaggccgaggcc

SEQ ID NO: 790 - DNA, 19 bp, Homo sapiens
ccaggccgcagcccaggag

SEQ ID NO: 791 - DNA, 19 bp, Homo sapiens
ggagccgccccaccgcagc

SEQ ID NO: 792 - DNA, 19 bp, Homo sapiens
gaagaggaaatgctggaaa

SEQ ID NO: 793 - DNA, 19 bp, Homo sapiens
caaaagatgcgacccgatt

SEQ ID NO: 794 - DNA, 19 bp, Homo sapiens
attcaagcacctccggaag

SEQ ID NO: 795 - DNA, 19 bp, Homo sapiens
gttccagtggagtccctgg

SEQ ID NO: 796 - DNA, 19 bp, Homo sapiens
gactgctgattcaagaagt

SEQ ID NO: 797 - DNA, 19 bp, Homo sapiens
gtgccaccaggatcaactg

SEQ ID NO: 798 - DNA, 19 bp, Homo sapiens
gatcaactgcaaggttgag

SEQ ID NO: 799 - DNA, 19 bp, Homo sapiens
actgcaaggttgagctgga

SEQ ID NO: 800 - DNA, 19 bp, Homo sapiens
ccagctctgcagcttcatc

SEQ ID NO: 801 - DNA, 19 bp, Homo sapiens
agcttcatcctgaagacca

SEQ ID NO: 802 - DNA, 19 bp, Homo sapiens
cttcatcctgaagaccagc

SEQ ID NO: 803 - DNA, 19 bp, Homo sapiens
ccagccagtgcaccctgaa

SEQ ID NO: 804 - DNA, 19 bp, Homo sapiens
cagtgcaccctgaaagagg

SEQ ID NO: 805 - DNA, 19 bp, Homo sapiens
tggcttcaaccctgagggc

SEQ ID NO: 806 - DNA, 19 bp, Homo sapiens
cttcaaccctgagggcaaa

SEQ ID NO: 807 - DNA, 19 bp, Homo sapiens
ttcaaccctgagggcaaag

SEQ ID NO: 808 - DNA, 19 bp, Homo sapiens
cttgctgaagaaaaccaag

SEQ ID NO: 809 - DNA, 19 bp, Homo sapiens
tgctgaagaaaaccaagaa

SEQ ID NO: 810 - DNA, 19 bp, Homo sapiens
ttgctgcagccatgtccag

SEQ ID NO: 811 - DNA, 19 bp, Homo sapiens
tgctgcagccatgtccagg

SEQ ID NO: 812 - DNA, 19 bp, Homo sapiens
agccatgtccaggtatgag

SEQ ID NO: 813 - DNA, 19 bp, Homo sapiens
agctcaagctggccattcc

SEQ ID NO: 814 - DNA, 19 bp, Homo sapiens
agaagggaagcaggttttc

SEQ ID NO: 815 - DNA, 19 bp, Homo sapiens
aagggaagcaggttttcct

SEQ ID NO: 816 - DNA, 19 bp, Homo sapiens
agaaagatgaacctactta

SEQ ID NO: 817 - DNA, 19 bp, Homo sapiens
atcctgaacatcaagaggg

SEQ ID NO: 818 - DNA, 19 bp, Homo sapiens
tcctgaacatcaagagggg

SEQ ID NO: 819 - DNA, 19 bp, Homo sapiens
ctgaacatcaagaggggca

SEQ ID NO: 820 - DNA, 19 bp, Homo sapiens
aacatcaagaggggcatca

SEQ ID NO: 821 - DNA, 19 bp, Homo sapiens
acatcaagaggggcatcat

SEQ ID NO: 822 - DNA, 19 bp, Homo sapiens
tcatttctgccctcctggt

SEQ ID NO: 823 - DNA, 19 bp, Homo sapiens
ttcccccagagacagaaga

SEQ ID NO: 824 - DNA, 19 bp, Homo sapiens
gaagaagccaagcaagtgt

SEQ ID NO: 825 - DNA, 19 bp, Homo sapiens
ttgtttctggataccgtgt

SEQ ID NO: 826 - DNA, 19 bp, Homo sapiens
tgtatggaaactgctccac

SEQ ID NO: 827 - DNA, 19 bp, Homo sapiens
aaactgctccactcacttt

SEQ ID NO: 828 - DNA, 19 bp, Homo sapiens
actcactttaccgtcaaga

SEQ ID NO: 829 - DNA, 19 bp, Homo sapiens
ctttaccgtcaagacgagg

SEQ ID NO: 830 - DNA, 19 bp, Homo sapiens
ttaccgtcaagacgaggaa

SEQ ID NO: 831 - DNA, 19 bp, Homo sapiens
acgaggaagggcaatgtgg

SEQ ID NO: 832 - DNA, 19 bp, Homo sapiens
cgaggaagggcaatgtggc

SEQ ID NO: 833 - DNA, 19 bp, Homo sapiens
gaggaagggcaatgtggca

SEQ ID NO: 834 - DNA, 19 bp, Homo sapiens
ggaagggcaatgtggcaac

SEQ ID NO: 835 - DNA, 19 bp, Homo sapiens
gaagggcaatgtggcaaca

SEQ ID NO: 836 - DNA, 19 bp, Homo sapiens
caggcatcagcccacttgc

SEQ ID NO: 837 - DNA, 19 bp, Homo sapiens
aggcatcagcccacttgct

SEQ ID NO: 838 - DNA, 19 bp, Homo sapiens
tcagcccacttgctctcat

SEQ ID NO: 839 - DNA, 19 bp, Homo sapiens
gtcaactctgatcagcagc

SEQ ID NO: 840 - DNA, 19 bp, Homo sapiens
ggacgctaagaggaagcat

SEQ ID NO: 841 - DNA, 19 bp, Homo sapiens
aaggagcaacacctcttcc

SEQ ID NO: 842 - DNA, 19 bp, Homo sapiens
aggagcaacacctcttcct

SEQ ID NO: 843 - DNA, 19 bp, Homo sapiens
caacacctcttcctgcctt

SEQ ID NO: 844 - DNA, 19 bp, Homo sapiens
aacacctcttcctgccttt

SEQ ID NO: 845 - DNA, 19 bp, Homo sapiens
acaagaataagtatgggat

SEQ ID NO: 846 - DNA, 19 bp, Homo sapiens
caagaataagtatgggatg

SEQ ID NO: 847 - DNA, 19 bp, Homo sapiens
tagcacaagtgacacagac

SEQ ID NO: 848 - DNA, 19 bp, Homo sapiens
agcacaagtgacacagact

SEQ ID NO: 849 - DNA, 19 bp, Homo sapiens
gcacaagtgacacagactt

SEQ ID NO: 850 - DNA, 19 bp, Homo sapiens
aacttgaagacacaccaaa

SEQ ID NO: 851 - DNA, 19 bp, Homo sapiens
gcttctttggtgaaggtac

SEQ ID NO: 852 - DNA, 19 bp, Homo sapiens
ctttggtgaaggtactaag

SEQ ID NO: 853 - DNA, 19 bp, Homo sapiens
tactaagaagatgggcctc

SEQ ID NO: 854 - DNA, 19 bp, Homo sapiens
tttgagagcaccaaatcca

SEQ ID NO: 855 - DNA, 19 bp, Homo sapiens
agagcaccaaatccacatc

SEQ ID NO: 856 - DNA, 19 bp, Homo sapiens
agctgttttgaagactctc

SEQ ID NO: 857 - DNA, 19 bp, Homo sapiens
tgaaaaaactaaccatctc

SEQ ID NO: 858 - DNA, 19 bp, Homo sapiens
gaaaaaactaaccatctct

SEQ ID NO: 859 - DNA, 19 bp, Homo sapiens
tctgagcaaaatatccaga

SEQ ID NO: 860 - DNA, 19 bp, Homo sapiens
tctcttcaataagctggtt

SEQ ID NO: 861 - DNA, 19 bp, Homo sapiens
ctgagctgagaggcctcag

SEQ ID NO: 862 - DNA, 19 bp, Homo sapiens
tgaagcagtcacatctctc

SEQ ID NO: 863 - DNA, 19 bp, Homo sapiens
aagcagtcacatctctctt

SEQ ID NO: 864 - DNA, 19 bp, Homo sapiens
ctctcttgccacagctgat

SEQ ID NO: 865 - DNA, 19 bp, Homo sapiens
tcttgccacagctgattga

SEQ ID NO: 866 - DNA, 19 bp, Homo sapiens
cttgccacagctgattgag

SEQ ID NO: 867 - DNA, 19 bp, Homo sapiens
tgaggtgtccagccccatc

SEQ ID NO: 868 - DNA, 19 bp, Homo sapiens
tcagtgtggacagcctcag

SEQ ID NO: 869 - DNA, 19 bp, Homo sapiens
acatcctccagtggctgaa

SEQ ID NO: 870 - DNA, 19 bp, Homo sapiens
gcacagcagctgcgagaga

SEQ ID NO: 871 - DNA, 19 bp, Homo sapiens
cagcagctgcgagagatct

SEQ ID NO: 872 - DNA, 19 bp, Homo sapiens
gcgagggatcagcgcagcc

SEQ ID NO: 873 - DNA, 19 bp, Homo sapiens
aagacaaaccctacaggga

SEQ ID NO: 874 - DNA, 19 bp, Homo sapiens
caggagctgctggacattg

SEQ ID NO: 875 - DNA, 19 bp, Homo sapiens
aggagctgctggacattgc

SEQ ID NO: 876 - DNA, 19 bp, Homo sapiens
ctgctggacattgctaatt

SEQ ID NO: 877 - DNA, 19 bp, Homo sapiens
gattacacctatttgattc

SEQ ID NO: 878 - DNA, 19 bp, Homo sapiens
atttgattctgcgggtcat

SEQ ID NO: 879 - DNA, 19 bp, Homo sapiens
tctgcgggtcattggaaat

SEQ ID NO: 880 - DNA, 19 bp, Homo sapiens
aaccatggagcagttaact

SEQ ID NO: 881 - DNA, 19 bp, Homo sapiens
ggagcagttaactccagaa

SEQ ID NO: 882 - DNA, 19 bp, Homo sapiens
actccagaactcaagtctt

SEQ ID NO: 883 - DNA, 19 bp, Homo sapiens
tccagaactcaagtcttca

SEQ ID NO: 884 - DNA, 19 bp, Homo sapiens
aagtacaaagccatcactg

SEQ ID NO: 885 - DNA, 19 bp, Homo sapiens
gccatcactgatgatccag

SEQ ID NO: 886 - DNA, 19 bp, Homo sapiens
ccatcactgatgatccaga

SEQ ID NO: 887 - DNA, 19 bp, Homo sapiens
atccagaaagctgccatcc

SEQ ID NO: 888 - DNA, 19 bp, Homo sapiens
cagaaagctgccatccagg

SEQ ID NO: 889 - DNA, 19 bp, Homo sapiens
acaaggaccaggaggttct

SEQ ID NO: 890 - DNA, 19 bp, Homo sapiens
aggaccaggaggttcttct

SEQ ID NO: 891 - DNA, 19 bp, Homo sapiens
accaggaggttcttcttca

SEQ ID NO: 892 - DNA, 19 bp, Homo sapiens
tcttcagactttccttgat

SEQ ID NO: 893 - DNA, 19 bp, Homo sapiens
ttcagactttccttgatga

SEQ ID NO: 894 - DNA, 19 bp, Homo sapiens
gttgatgaggagtccttca

SEQ ID NO: 895 - DNA, 19 bp, Homo sapiens
cttcacaggcagatattaa

SEQ ID NO: 896 - DNA, 19 bp, Homo sapiens
ttcacaggcagatattaac

SEQ ID NO: 897 - DNA, 19 bp, Homo sapiens
ggcagatattaacaaaatt

SEQ ID NO: 898 - DNA, 19 bp, Homo sapiens
atattaacaaaattgtcca

SEQ ID NO: 899 - DNA, 19 bp, Homo sapiens
acaaaattgtccaaattct

SEQ ID NO: 900 - DNA, 19 bp, Homo sapiens
gagcaagtgaagaactttg

SEQ ID NO: 901 - DNA, 19 bp, Homo sapiens
gtgaagaactttgtggctt

SEQ ID NO: 902 - DNA, 19 bp, Homo sapiens
agaactttgtggcttccca

SEQ ID NO: 903 - DNA, 19 bp, Homo sapiens
tttgtggcttcccatattg

SEQ ID NO: 904 - DNA, 19 bp, Homo sapiens
tggcttcccatattgccaa

SEQ ID NO: 905 - DNA, 19 bp, Homo sapiens
ttcccatattgccaatatc

SEQ ID NO: 906 - DNA, 19 bp, Homo sapiens
tcccatattgccaatatct

SEQ ID NO: 907 - DNA, 19 bp, Homo sapiens
ttgccaatatcttgaactc

SEQ ID NO: 908 - DNA, 19 bp, Homo sapiens
ttggatatccaagatctga

SEQ ID NO: 909 - DNA, 19 bp, Homo sapiens
tccaagatctgaaaaagtt

SEQ ID NO: 910 - DNA, 19 bp, Homo sapiens
ctgaaaaagttagtgaaag

SEQ ID NO: 911 - DNA, 19 bp, Homo sapiens
agttagtgaaagaagttct

SEQ ID NO: 912 - DNA, 19 bp, Homo sapiens
aatctcaacttccaactgt

SEQ ID NO: 913 - DNA, 19 bp, Homo sapiens
gtcatggacttcagaaaat

SEQ ID NO: 914 - DNA, 19 bp, Homo sapiens
tcaactctacaaatctgtt

SEQ ID NO: 915 - DNA, 19 bp, Homo sapiens
aactctacaaatctgtttc

SEQ ID NO: 916 - DNA, 19 bp, Homo sapiens
aaatagaagggaatcttat

SEQ ID NO: 917 - DNA, 19 bp, Homo sapiens
agaagggaatcttatattt

SEQ ID NO: 918 - DNA, 19 bp, Homo sapiens
gaagggaatcttatatttg

SEQ ID NO: 919 - DNA, 19 bp, Homo sapiens
tgatccaaataactacctt

SEQ ID NO: 920 - DNA, 19 bp, Homo sapiens
tggatttgcttcagctgac

SEQ ID NO: 921 - DNA, 19 bp, Homo sapiens
tttgcttcagctgacctca

SEQ ID NO: 922 - DNA, 19 bp, Homo sapiens
cttggaaggaaaaggcttt

SEQ ID NO: 923 - DNA, 19 bp, Homo sapiens
tggaaggaaaaggctttga

SEQ ID NO: 924 - DNA, 19 bp, Homo sapiens
ggctttgagccaacattgg

SEQ ID NO: 925 - DNA, 19 bp, Homo sapiens
tgagccaacattggaagct

SEQ ID NO: 926 - DNA, 19 bp, Homo sapiens
gagccaacattggaagctc

SEQ ID NO: 927 - DNA, 19 bp, Homo sapiens
aacattggaagctcttttt

SEQ ID NO: 928 - DNA, 19 bp, Homo sapiens
tggaagctctttttgggaa

SEQ ID NO: 929 - DNA, 19 bp, Homo sapiens
ctctttttgggaagcaagg

SEQ ID NO: 930 - DNA, 19 bp, Homo sapiens
tttttgggaagcaaggatt

SEQ ID NO: 931 - DNA, 19 bp, Homo sapiens
ttttcccagacagtgtcaa

SEQ ID NO: 932 - DNA, 19 bp, Homo sapiens
ttggctataccaaagatga

SEQ ID NO: 933 - DNA, 19 bp, Homo sapiens
ataccaaagatgataaaca

SEQ ID NO: 934 - DNA, 19 bp, Homo sapiens
gagcaggatatggtaaatg

SEQ ID NO: 935 - DNA, 19 bp, Homo sapiens
atggtaaatggaataatgc

SEQ ID NO: 936 - DNA, 19 bp, Homo sapiens
tggtaaatggaataatgct

SEQ ID NO: 937 - DNA, 19 bp, Homo sapiens
taaatggaataatgctcag

SEQ ID NO: 938 - DNA, 19 bp, Homo sapiens
tggaataatgctcagtgtt

SEQ ID NO: 939 - DNA, 19 bp, Homo sapiens
tcagtgttgagaagctgat

SEQ ID NO: 940 - DNA, 19 bp, Homo sapiens
cagtgttgagaagctgatt

SEQ ID NO: 941 - DNA, 19 bp, Homo sapiens
agtgttgagaagctgatta

SEQ ID NO: 942 - DNA, 19 bp, Homo sapiens
gattaaagatttgaaatcc

SEQ ID NO: 943 - DNA, 19 bp, Homo sapiens
gatttgaaatccaaagaag

SEQ ID NO: 944 - DNA, 19 bp, Homo sapiens
atttgaaatccaaagaagt

SEQ ID NO: 945 - DNA, 19 bp, Homo sapiens
atccaaagaagtcccggaa

SEQ ID NO: 946 - DNA, 19 bp, Homo sapiens
tccaaagaagtcccggaag

SEQ ID NO: 947 - DNA, 19 bp, Homo sapiens
agagcctacctccgcatct

SEQ ID NO: 948 - DNA, 19 bp, Homo sapiens
gagcctacctccgcatctt

SEQ ID NO: 949 - DNA, 19 bp, Homo sapiens
cttgggagaggagcttggt

SEQ ID NO: 950 - DNA, 19 bp, Homo sapiens
ggagcttggttttgccagt

SEQ ID NO: 951 - DNA, 19 bp, Homo sapiens
ttggttttgccagtctcca

SEQ ID NO: 952 - DNA, 19 bp, Homo sapiens
cagtctccatgacctccag

SEQ ID NO: 953 - DNA, 19 bp, Homo sapiens
ctccatgacctccagctcc

SEQ ID NO: 954 - DNA, 19 bp, Homo sapiens
ctgggaaagctgcttctga

SEQ ID NO: 955 - DNA, 19 bp, Homo sapiens
gaggtcatcaggaagggct

SEQ ID NO: 956 - DNA, 19 bp, Homo sapiens
aagaatgacttttttcttc

SEQ ID NO: 957 - DNA, 19 bp, Homo sapiens
cttttttcttcactacatc

SEQ ID NO: 958 - DNA, 19 bp, Homo sapiens
catcttcatggagaatgcc

SEQ ID NO: 959 - DNA, 19 bp, Homo sapiens
cttcatggagaatgccttt

SEQ ID NO: 960 - DNA, 19 bp, Homo sapiens
aatgcctttgaactcccca

SEQ ID NO: 961 - DNA, 19 bp, Homo sapiens
gcctttgaactccccactg

SEQ ID NO: 962 - DNA, 19 bp, Homo sapiens
caaggctggagtaaaactg

SEQ ID NO: 963 - DNA, 19 bp, Homo sapiens
tggagtaaaactggaagta

SEQ ID NO: 964 - DNA, 19 bp, Homo sapiens
ggaagtagccaacatgcag

SEQ ID NO: 965 - DNA, 19 bp, Homo sapiens
tttgtgacaaatatgggca

SEQ ID NO: 966 - DNA, 19 bp, Homo sapiens
tgtgacaaatatgggcatc

SEQ ID NO: 967 - DNA, 19 bp, Homo sapiens
ggacttcgctaggagtggg

SEQ ID NO: 968 - DNA, 19 bp, Homo sapiens
gtggggtccagatgaacac

SEQ ID NO: 969 - DNA, 19 bp, Homo sapiens
ttccacgagtcgggtctgg

SEQ ID NO: 970 - DNA, 19 bp, Homo sapiens
agtcgggtctggaggctca

SEQ ID NO: 971 - DNA, 19 bp, Homo sapiens
tcgggtctggaggctcatg

SEQ ID NO: 972 - DNA, 19 bp, Homo sapiens
aaaagctgggaagctgaag

SEQ ID NO: 973 - DNA, 19 bp, Homo sapiens
aagctgaagtttatcattc

SEQ ID NO: 974 - DNA, 19 bp, Homo sapiens
gagaccagtcaagctgctc

SEQ ID NO: 975 - DNA, 19 bp, Homo sapiens
gcaacacattacatttggt

SEQ ID NO: 976 - DNA, 19 bp, Homo sapiens
acattacatttggtctcta

SEQ ID NO: 977 - DNA, 19 bp, Homo sapiens
cattacatttggtctctac

SEQ ID NO: 978 - DNA, 19 bp, Homo sapiens
aaacggaggtgatcccacc

SEQ ID NO: 979 - DNA, 19 bp, Homo sapiens
attgagaacaggcagtcct

SEQ ID NO: 980 - DNA, 19 bp, Homo sapiens
tgagaacaggcagtcctgg

SEQ ID NO: 981 - DNA, 19 bp, Homo sapiens
ctgcacctcaggcgcttac

SEQ ID NO: 982 - DNA, 19 bp, Homo sapiens
tccacagactccgcctcct

SEQ ID NO: 983 - DNA, 19 bp, Homo sapiens
ctgaccggggacaccagat

SEQ ID NO: 984 - DNA, 19 bp, Homo sapiens
tagagctggaactgaggcc

SEQ ID NO: 985 - DNA, 19 bp, Homo sapiens
ctatgagctccagagagag

SEQ ID NO: 986 - DNA, 19 bp, Homo sapiens
cttggtggataccctgaag

SEQ ID NO: 987 - DNA, 19 bp, Homo sapiens
ttgtaactcaagcagaagg

SEQ ID NO: 988 - DNA, 19 bp, Homo sapiens
taactcaagcagaaggtgc

SEQ ID NO: 989 - DNA, 19 bp, Homo sapiens
gcagaaggtgcgaagcaga

SEQ ID NO: 990 - DNA, 19 bp, Homo sapiens
cagaaggtgcgaagcagac

SEQ ID NO: 991 - DNA, 19 bp, Homo sapiens
gtatgaccttgtccagtga

SEQ ID NO: 992 - DNA, 19 bp, Homo sapiens
tatgaccttgtccagtgaa

SEQ ID NO: 993 - DNA, 19 bp, Homo sapiens
gaagtccaaattccggatt

SEQ ID NO: 994 - DNA, 19 bp, Homo sapiens
gagggcaaaacgtcttaca

SEQ ID NO: 995 - DNA, 19 bp, Homo sapiens
agggcaaaacgtcttacag

SEQ ID NO: 996 - DNA, 19 bp, Homo sapiens
gactcaccctggacattca

SEQ ID NO: 997 - DNA, 19 bp, Homo sapiens
ctggacattcagaacaaga

SEQ ID NO: 998 - DNA, 19 bp, Homo sapiens
tcatgggcgacctaagttg

SEQ ID NO: 999 - DNA, 19 bp, Homo sapiens
tgggcgacctaagttgtga

SEQ ID NO: 1000 - DNA, 19 bp, Homo sapiens
agttgtgacacaaaggaag

SEQ ID NO: 1001 - DNA, 19 bp, Homo sapiens
tgacacaaaggaagaaaga

SEQ ID NO: 1002 - DNA, 19 bp, Homo sapiens
gacacaaaggaagaaagaa

SEQ ID NO: 1003 - DNA, 19 bp, Homo sapiens
ggaagaaagaaaaatcaag

SEQ ID NO: 1004 - DNA, 19 bp, Homo sapiens
cttccgttctgtaatggcc

SEQ ID NO: 1005 - DNA, 19 bp, Homo sapiens
tggaactctctccatggca

SEQ ID NO: 1006 - DNA, 19 bp, Homo sapiens
taacaaattccttgacatg

SEQ ID NO: 1007 - DNA, 19 bp, Homo sapiens
caataagatcaatagcaaa

SEQ ID NO: 1008 - DNA, 19 bp, Homo sapiens
tccatgtcccatttacaga

SEQ ID NO: 1009 - DNA, 19 bp, Homo sapiens
tggacctgcaccaaagctg

SEQ ID NO: 1010 - DNA, 19 bp, Homo sapiens
gcagccctgggaaaactcc

SEQ ID NO: 1011 - DNA, 19 bp, Homo sapiens
tggagggtagtcataacag

SEQ ID NO: 1012 - DNA, 19 bp, Homo sapiens
tgcagagctttctgccact

SEQ ID NO: 1013 - DNA, 19 bp, Homo sapiens
agattcctttgccttttgg

SEQ ID NO: 1014 - DNA, 19 bp, Homo sapiens
aaattctcttttcttttca

SEQ ID NO: 1015 - DNA, 19 bp, Homo sapiens
tgctagtgaggccaacact

SEQ ID NO: 1016 - DNA, 19 bp, Homo sapiens
tgatgatatctggaacctt

SEQ ID NO: 1017 - DNA, 19 bp, Homo sapiens
tgctaagaaccttactgac

SEQ ID NO: 1018 - DNA, 19 bp, Homo sapiens
ttcactgttcctgaaatca

SEQ ID NO: 1019 - DNA, 19 bp, Homo sapiens
agaaaaggcacaccttgac

SEQ ID NO: 1020 - DNA, 19 bp, Homo sapiens
ttccaatttccctgtggat

SEQ ID NO: 1021 - DNA, 19 bp, Homo sapiens
acttcagagaaatacaaat

SEQ ID NO: 1022 - DNA, 19 bp, Homo sapiens
ccagacttccgtttaccag

SEQ ID NO: 1023 - DNA, 19 bp, Homo sapiens
tgaagtgtagtctcctggt

SEQ ID NO: 1024 - DNA, 19 bp, Homo sapiens
attccatcacaaatccttt

SEQ ID NO: 1025 - DNA, 19 bp, Homo sapiens
tggatctaaatgcagtagc

SEQ ID NO: 1026 - DNA, 19 bp, Homo sapiens
caaagaagtcaagattgat

SEQ ID NO: 1027 - DNA, 19 bp, Homo sapiens
atgtgttaacaaaatattc

SEQ ID NO: 1028 - DNA, 19 bp, Homo sapiens
gccagaagtgagatcctcg

SEQ ID NO: 1029 - DNA, 19 bp, Homo sapiens
ctctgagcaacaaatttgt

SEQ ID NO: 1030 - DNA, 19 bp, Homo sapiens
ctccatggcaaatgtcagc

SEQ ID NO: 1031 - DNA, 19 bp, Homo sapiens
gagtcattgaggttcttca

SEQ ID NO: 1032 - DNA, 19 bp, Homo sapiens
tgttcataagggaggtagg

SEQ ID NO: 1033 - DNA, 19 bp, Homo sapiens
atgttcataagggaggtag

SEQ ID NO: 1034 - DNA, 19 bp, Homo sapiens
gcttggttttgccagtctc

SEQ ID NO: 1035 - DNA, 19 bp, Homo sapiens
cttgaacacaaagtcagtg

SEQ ID NO: 1036 - DNA, 19 bp, Homo sapiens
actgggaagtgcttatcag

SEQ ID NO: 1037 - DNA, 19 bp, Homo sapiens
cttccccaaagagaccagt

SEQ ID NO: 1038 - DNA, 19 bp, Homo sapiens
tctggcatttactttctct

SEQ ID NO: 1039 - DNA, 19 bp, Homo sapiens
agttgaaggagactattca

SEQ ID NO: 1040 - DNA, 19 bp, Homo sapiens
ctggttactgagctgagag

SEQ ID NO: 1041 - DNA, 19 bp, Homo sapiens
agagctgccagtccttcat

SEQ ID NO: 1042 - DNA, 19 bp, Homo sapiens
cctcctacagtggtggcaa

SEQ ID NO: 1043 - DNA, 19 bp, Homo sapiens
ctggattccacatgcagct

SEQ ID NO: 1044 - DNA, 19 bp, Homo sapiens
ggaggctttaagttcagca

SEQ ID NO: 1045 - DNA, 19 bp, Homo sapiens
ttgggagagacaagtttca

SEQ ID NO: 1046 - DNA, 19 bp, Homo sapiens
tcagaagctaagcaatgtc

SEQ ID NO: 1047 - DNA, 19 bp, Homo sapiens
aggagagtccaaattagaa

SEQ ID NO: 1048 - DNA, 19 bp, Homo sapiens
tctgaattcattcaattgg

SEQ ID NO: 1049 - DNA, 19 bp, Homo sapiens
aactaccctcactgccttt

SEQ ID NO: 1050 - DNA, 19 bp, Homo sapiens
gaacctctggcatttactt

SEQ ID NO: 1051 - DNA, 19 bp, Homo sapiens
attctctggtaactacttt

SEQ ID NO: 1052 - DNA, 19 bp, Homo sapiens
catcttaggcactgacaaa

SEQ ID NO: 1053 - DNA, 19 bp, Homo sapiens
tttagccatcggctcaaca

SEQ ID NO: 1054 - DNA, 19 bp, Homo sapiens
attcctttaacaattcctg

SEQ ID NO: 1055 - DNA, 19 bp, Homo sapiens
cattcctttaacaattcct

SEQ ID NO: 1056 - DNA, 19 bp, Homo sapiens
gtcagtcttcaggctcttc

SEQ ID NO: 1057 - DNA, 19 bp, Homo sapiens
agaaggatggcattttttg

SEQ ID NO: 1058 - DNA, 19 bp, Homo sapiens
ttcagagccaaagtccatg

SEQ ID NO: 1059 - DNA, 19 bp, Homo sapiens
ttactccaacgccagctcc

SEQ ID NO: 1060 - DNA, 19 bp, Homo sapiens
ctctctggggcatctatga

SEQ ID NO: 1061 - DNA, 19 bp, Homo sapiens
ctctcaagaccacagaggt

SEQ ID NO: 1062 - DNA, 19 bp, Homo sapiens
tctgaaagacaacgtgccc

SEQ ID NO: 1063 - DNA, 19 bp, Homo sapiens
tgttgctaaggttcagggt

SEQ ID NO: 1064 - DNA, 19 bp, Homo sapiens
cacaaattagtttcaccat

SEQ ID NO: 1065 - DNA, 19 bp, Homo sapiens
attccagcttccccacatc

SEQ ID NO: 1066 - DNA, 19 bp, Homo sapiens
ttttttggaaatgccattg

SEQ ID NO: 1067 - DNA, 19 bp, Homo sapiens
tcatgtgatgggtctctac

SEQ ID NO: 1068 - DNA, 19 bp, Homo sapiens
agtcaagaaggacttaagc

SEQ ID NO: 1069 - DNA, 19 bp, Homo sapiens
gacttcagagaaatacaaa

SEQ ID NO: 1070 - DNA, 19 bp, Homo sapiens
tgacttcagagaaatacaa

SEQ ID NO: 1071 - DNA, 19 bp, Homo sapiens
agcgagaatcaccctgcca

SEQ ID NO: 1072 - DNA, 19 bp, Homo sapiens
aaaggagatgtcaagggtt

SEQ ID NO: 1073 - DNA, 19 bp, Homo sapiens
tcatttgaaagaataaatg

SEQ ID NO: 1074 - DNA, 19 bp, Homo sapiens
taagaaccttactgacttt

SEQ ID NO: 1075 - DNA, 19 bp, Homo sapiens
aaggacttcaggaatggga

SEQ ID NO: 1076 - DNA, 19 bp, Homo sapiens
aaattaaaaagtcttgatg

SEQ ID NO: 1077 - DNA, 19 bp, Homo sapiens
taaaccaaaacttggttta

SEQ ID NO: 1078 - DNA, 19 bp, Homo sapiens
ttcaaagacttaaaaaata

SEQ ID NO: 1079 - DNA, 19 bp, Homo sapiens
ataaagaaattaaagtcat

SEQ ID NO: 1080 - DNA, 19 bp, Homo sapiens
atatattgtcagtgcctct

SEQ ID NO: 1081 - DNA, 19 bp, Homo sapiens
tctaaattcagttcttgtc

SEQ ID NO: 1082 - DNA, 19 bp, Homo sapiens
acaaagtcagtgccctgct

SEQ ID NO: 1083 - DNA, 19 bp, Homo sapiens
cctttgtgtacaccaaaaa

SEQ ID NO: 1084 - DNA, 19 bp, Homo sapiens
gcctttgtgtacaccaaaa

SEQ ID NO: 1085 - DNA, 19 bp, Homo sapiens
ttcagaaatactgttttcc

SEQ ID NO: 1086 - DNA, 19 bp, Homo sapiens
ctgggacctaccaagagtg

SEQ ID NO: 1087 - DNA, 19 bp, Homo sapiens
cacatttcaaggaattgtg

SEQ ID NO: 1088 - DNA, 19 bp, Homo sapiens
ggaactgttgactcaggaa

SEQ ID NO: 1089 - DNA, 19 bp, Homo sapiens
agagccaggtcgagctttc

SEQ ID NO: 1090 - DNA, 19 bp, Homo sapiens
acagctgaaagagatgaaa

SEQ ID NO: 1091 - DNA, 19 bp, Homo sapiens
ctgcacgctttgaggtaga

SEQ ID NO: 1092 - DNA, 19 bp, Homo sapiens
actgcacgctttgaggtag

SEQ ID NO: 1093 - DNA, 19 bp, Homo sapiens
ttggccaggaagtggccct

SEQ ID NO: 1094 - DNA, 19 bp, Homo sapiens
ctttttcaccaacggagaa

SEQ ID NO: 1095 - DNA, 19 bp, Homo sapiens
ataaactgcaagatttttc

SEQ ID NO: 1096 - DNA, 19 bp, Homo sapiens
agaaaatcaggatctgagt

SEQ ID NO: 1097 - DNA, 19 bp, Homo sapiens
gattaccaccagcagttta

SEQ ID NO: 1098 - DNA, 19 bp, Homo sapiens
cttcgtgaagaatattttg

SEQ ID NO: 1099 - DNA, 19 bp, Homo sapiens
aacacttacttgaattcca

SEQ ID NO: 1100 - DNA, 19 bp, Homo sapiens
cttcagagaaatacaaatc

SEQ ID NO: 1101 - DNA, 19 bp, Homo sapiens
acttcagagaaatacaaat

SEQ ID NO: 1102 - DNA, 19 bp, Homo sapiens
caaagaagtcaagattgat

SEQ ID NO: 1103 - DNA, 19 bp, Homo sapiens
ctggaaagttaaaacaaca

SEQ ID NO: 1104 - DNA, 19 bp, Homo sapiens
accaaagctggcaccaggg

SEQ ID NO: 1105 - DNA, 19 bp, Homo sapiens
aaagccattcagtctctca

SEQ ID NO: 1106 - DNA, 19 bp, Homo sapiens
acttttctaaacttgaaat

SEQ ID NO: 1107 - DNA, 19 bp, Homo sapiens
ttccggggaaacctgggat

SEQ ID NO: 1108 - DNA, 19 bp, Homo sapiens
agatggtacgttagcctct

SEQ ID NO: 1109 - DNA, 19 bp, Homo sapiens
tgggaactacaatttcatt

SEQ ID NO: 1110 - DNA, 19 bp, Homo sapiens
aatcttcaatttattcttc

SEQ ID NO: 1111 - DNA, 19 bp, Homo sapiens
cttcaggttccatcgtgca

SEQ ID NO: 1112 - DNA, 19 bp, Homo sapiens
caaaacctactgtctcttc

SEQ ID NO: 1113 - DNA, 19 bp, Homo sapiens
ccatatgaaagtcaagcat

SEQ ID NO: 1114 - DNA, 19 bp, Homo sapiens
cagattctcagatgaggga

SEQ ID NO: 1115 - DNA, 19 bp, Homo sapiens
acttttctaaacttgaaat

SEQ ID NO: 1116 - DNA, 19 bp, Homo sapiens
attatgttgaaacagtcct

SEQ ID NO: 1117 - DNA, 19 bp, Homo sapiens
attgttgctcatctccttt

SEQ ID NO: 1118 - DNA, 19 bp, Homo sapiens
ttctgattaccaccagcag

SEQ ID NO: 1119 - DNA, 19 bp, Homo sapiens
ttttaaaagaaatcttcaa

SEQ ID NO: 1120 - DNA, 19 bp, Homo sapiens
caaaacctactgtctcttc

SEQ ID NO: 1121 - DNA, 19 bp, Homo sapiens
aaatgtcagctcttgttca

SEQ ID NO: 1122 - DNA, 19 bp, Homo sapiens
gcaagtcagcccagttcct

SEQ ID NO: 1123 - DNA, 19 bp, Homo sapiens
cagccattgacatgagcac

SEQ ID NO: 1124 - DNA, 19 bp, Homo sapiens
cagctccacagactccgcc

SEQ ID NO: 1125 - DNA, 19 bp, Homo sapiens
agcagaaggtgcgaagcag

SEQ ID NO: 1126 - DNA, 19 bp, Homo sapiens
cctggattccacatgcagc

SEQ ID NO: 1127 - DNA, 19 bp, Homo sapiens
tttttcttcactacatctt

SEQ ID NO: 1128 - DNA, 19 bp, Homo sapiens
ccagacttccacatcccag

SEQ ID NO: 1129 - DNA, 19 bp, Homo sapiens
agcatgcctagtttctcca

SEQ ID NO: 1130 - DNA, 19 bp, Homo sapiens
cagcatgcctagtttctcc

SEQ ID NO: 1131 - DNA, 19 bp, Homo sapiens
tcttccatcacttgaccca

SEQ ID NO: 1132 - DNA, 19 bp, Homo sapiens
gcacaccttgacattgcag

SEQ ID NO: 1133 - DNA, 19 bp, Homo sapiens
gcaggctgaactggtggca

SEQ ID NO: 1134 - DNA, 19 bp, Homo sapiens
tgcaggctgaactggtggc

SEQ ID NO: 1135 - DNA, 19 bp, Homo sapiens
cctccacctctgatctgca

SEQ ID NO: 1136 - DNA, 19 bp, Homo sapiens
aacccctacatgaagcttg

SEQ ID NO: 1137 - DNA, 19 bp, Homo sapiens
tcaggaagcttctcaagag

SEQ ID NO: 1138 - DNA, 19 bp, Homo sapiens
ggtcttgagttaaatgctg

SEQ ID NO: 1139 - DNA, 19 bp, Homo sapiens
ctggacgctaagaggaagc

SEQ ID NO: 1140 - DNA, 19 bp, Homo sapiens
tggcatggcattatgatga

SEQ ID NO: 1141 - DNA, 19 bp, Homo sapiens
ctcaaccttaatgattttc

SEQ ID NO: 1142 - DNA, 19 bp, Homo sapiens
gcaagctatacagtattct

SEQ ID NO: 1143 - DNA, 19 bp, Homo sapiens
ctgcaggggatcccccaga

SEQ ID NO: 1144 - DNA, 19 bp, Homo sapiens
tggaagtgtcagtggcaaa

SEQ ID NO: 1145 - DNA, 19 bp, Homo sapiens
agaataaatgacgttcttg

SEQ ID NO: 1146 - DNA, 19 bp, Homo sapiens
cgtctacactatcatgtga

SEQ ID NO: 1147 - DNA, 19 bp, Homo sapiens
tccttgacatgttgataaa

SEQ ID NO: 1148 - DNA, 19 bp, Homo sapiens
ttccagaaagcagccagtg

SEQ ID NO: 1149 - DNA, 19 bp, Homo sapiens
cttcatacacattaatcct

SEQ ID NO: 1150 - DNA, 19 bp, Homo sapiens
gaagtagtactgcatcttg

SEQ ID NO: 1151 - DNA, 19 bp, Homo sapiens
ttcaattcttcaatgctgt

SEQ ID NO: 1152 - DNA, 19 bp, Homo sapiens
agatttgaggattccatca

SEQ ID NO: 1153 - DNA, 19 bp, Homo sapiens
caaggagaaactgactgct

SEQ ID NO: 1154 - DNA, 19 bp, Homo sapiens
tgtagtctcctggtgctgg

SEQ ID NO: 1155 - DNA, 19 bp, Homo sapiens
ctggagcttagtaatggag

SEQ ID NO: 1156 - DNA, 19 bp, Homo sapiens
tcagatgagggaacacatg

SEQ ID NO: 1157 - DNA, 19 bp, Homo sapiens
gccaccctggaactctctc

SEQ ID NO: 1158 - DNA, 19 bp, Homo sapiens
tgatcccacctctcattga

SEQ ID NO: 1159 - DNA, 19 bp, Homo sapiens
ctcagggatctgaaggtgg

SEQ ID NO: 1160 - DNA, 19 bp, Homo sapiens
tcttgagttaaatgctgac

SEQ ID NO: 1161 - DNA, 19 bp, Homo sapiens
aggtatattcgaaagtcca

SEQ ID NO: 1162 - DNA, 19 bp, Homo sapiens
caggtatattcgaaagtcc

SEQ ID NO: 1163 - DNA, 19 bp, Homo sapiens
tttcacatgccaaggagaa

SEQ ID NO: 1164 - DNA, 19 bp, Homo sapiens
ttgaagtgtagtctcctgg

SEQ ID NO: 1165 - DNA, 19 bp, Homo sapiens
catttctgattggtggact

SEQ ID NO: 1166 - DNA, 19 bp, Homo sapiens
aaagtgccacttttactca

SEQ ID NO: 1167 - DNA, 19 bp, Homo sapiens
acaaagtcagtgccctgct

SEQ ID NO: 1168 - DNA, 19 bp, Homo sapiens
aagtccataatggttcaga

SEQ ID NO: 1169 - DNA, 19 bp, Homo sapiens
ttctgaatatattgtcagt

SEQ ID NO: 1170 - DNA, 19 bp, Homo sapiens
ggctcaccctgagagaagt

SEQ ID NO: 1171 - DNA, 19 bp, Homo sapiens
aggaagatatgaagatgga

SEQ ID NO: 1172 - DNA, 19 bp, Homo sapiens
caaatttgtggagggtagt

SEQ ID NO: 1173 - DNA, 19 bp, Homo sapiens
tcagtataagtacaaccaa

SEQ ID NO: 1174 - DNA, 19 bp, Homo sapiens
tcccgattcacgcttccaa

SEQ ID NO: 1175 - DNA, 19 bp, Homo sapiens
cttcagaaagctaccttcc

SEQ ID NO: 1176 - DNA, 19 bp, Homo sapiens
tgaccttctctaagcaaaa

SEQ ID NO: 1177 - DNA, 19 bp, Homo sapiens
agcttggttttgccagtct

SEQ ID NO: 1178 - DNA, 19 bp, Homo sapiens
atctcgtgtctaggaaaag

SEQ ID NO: 1179 - DNA, 19 bp, Homo sapiens
ctcaaggataacgtgtttg

SEQ ID NO: 1180 - DNA, 19 bp, Homo sapiens
ttatcttattaattatatc

SEQ ID NO: 1181 - DNA, 19 bp, Homo sapiens
caacacttacttgaattcc

SEQ ID NO: 1182 - DNA, 19 bp, Homo sapiens
gacttcagagaaatacaaa

SEQ ID NO: 1183 - DNA, 19 bp, Homo sapiens
tccaatttccctgtggatc

SEQ ID NO: 1184 - DNA, 19 bp, Homo sapiens
tgaccacacaaacagtctg

SEQ ID NO: 1185 - DNA, 19 bp, Homo sapiens
tgaagtccggattcattct

SEQ ID NO: 1186 - DNA, 19 bp, Homo sapiens
cagctcaaccgtacagttc

SEQ ID NO: 1187 - DNA, 19 bp, Homo sapiens
tgacttcagtgcagaatat

SEQ ID NO: 1188 - DNA, 19 bp, Homo sapiens
tggccccgtttaccatgac

SEQ ID NO: 1189 - DNA, 19 bp, Homo sapiens
aggaggctttaagttcagc

SEQ ID NO: 1190 - DNA, 19 bp, Homo sapiens
gtctcttcctccatggaat

SEQ ID NO: 1191 - DNA, 19 bp, Homo sapiens
actgactgcacgctttgag

SEQ ID NO: 1192 - DNA, 19 bp, Homo sapiens
ctgagagaagtgtcttcaa

SEQ ID NO: 1193 - DNA, 19 bp, Homo sapiens
ggacggtactgtcccaggt

SEQ ID NO: 1194 - DNA, 19 bp, Homo sapiens
ggaaggcagagtttactgg

SEQ ID NO: 1195 - DNA, 19 bp, Homo sapiens
atttcctaaagctggatgt

SEQ ID NO: 1196 - DNA, 19 bp, Homo sapiens
ataaactgcaagatttttc

SEQ ID NO: 1197 - DNA, 19 bp, Homo sapiens
gaaacaatgcattagattt

SEQ ID NO: 1198 - DNA, 19 bp, Homo sapiens
tctcccgtgtataatgcca

SEQ ID NO: 1199 - DNA, 19 bp, Homo sapiens
tcaaaacctactgtctctt

SEQ ID NO: 1200 - DNA, 19 bp, Homo sapiens
gggaactacaatttcattt

SEQ ID NO: 1201 - DNA, 19 bp, Homo sapiens
caggctgattacgagtcat

SEQ ID NO: 1202 - DNA, 19 bp, Homo sapiens
ccacgaaaaatatggaagt

SEQ ID NO: 1203 - DNA, 19 bp, Homo sapiens
ccatcagttcagataaact

SEQ ID NO: 1204 - DNA, 19 bp, Homo sapiens
attgacctgtccattcaaa

SEQ ID NO: 1205 - DNA, 19 bp, Homo sapiens
ctggaattgtcattccttc

SEQ ID NO: 1206 - DNA, 19 bp, Homo sapiens
ttttaacaaaagtggaagt

SEQ ID NO: 1207 - DNA, 19 bp, Homo sapiens
catcactgccaaaggagag

SEQ ID NO: 1208 - DNA, 19 bp, Homo sapiens
tgactcactcattgatttt

SEQ ID NO: 1209 - DNA, 19 bp, Homo sapiens
ccacaaacaatgaagggaa

SEQ ID NO: 1210 - DNA, 19 bp, Homo sapiens
atgggaaaaaacaggcttg

SEQ ID NO: 1211 - DNA, 19 bp, Homo sapiens
atgggaagtataagaactt

SEQ ID NO: 1212 - DNA, 19 bp, Homo sapiens
agaaaaacaaacacaggca

SEQ ID NO: 1213 - DNA, 19 bp, Homo sapiens
tgaagtgtagtctcctggt

SEQ ID NO: 1214 - DNA, 19 bp, Homo sapiens
ctgaaatacaatgctctgg

SEQ ID NO: 1215 - DNA, 19 bp, Homo sapiens
agacacctgattttatagt

SEQ ID NO: 1216 - DNA, 19 bp, Homo sapiens
tgaaggctgactctgtggt

SEQ ID NO: 1217 - DNA, 19 bp, Homo sapiens
ctgagcaacaaatttgtgg

SEQ ID NO: 1218 - DNA, 19 bp, Homo sapiens
tttctctcatgattacaaa

SEQ ID NO: 1219 - DNA, 19 bp, Homo sapiens
tcaaggataacgtgtttga

SEQ ID NO: 1220 - DNA, 19 bp, Homo sapiens
gtcagatattgttgctcat

SEQ ID NO: 1221 - DNA, 19 bp, Homo sapiens
cattcattgaagatgttaa

SEQ ID NO: 1222 - DNA, 19 bp, Homo sapiens
ggcaaatttgaaggacttc

SEQ ID NO: 1223 - DNA, 19 bp, Homo sapiens
tggcaaatttgaaggactt

SEQ ID NO: 1224 - DNA, 19 bp, Homo sapiens
cagaatccagatacaagaa

SEQ ID NO: 1225 - DNA, 19 bp, Homo sapiens
tgggtctttccagagccag

SEQ ID NO: 1226 - DNA, 19 bp, Homo sapiens
tgagaagccccaagaattt

SEQ ID NO: 1227 - DNA, 19 bp, Homo sapiens
tcaaattcctggatacact

SEQ ID NO: 1228 - DNA, 19 bp, Homo sapiens
cctgaccttcacataccag

SEQ ID NO: 1229 - DNA, 19 bp, Homo sapiens
aagtaaaagaaaattttgc

SEQ ID NO: 1230 - DNA, 19 bp, Homo sapiens
tgaagtaaaagaaaatttt

SEQ ID NO: 1231 - DNA, 19 bp, Homo sapiens
ttaaggacttccattctga

SEQ ID NO: 1232 - DNA, 19 bp, Homo sapiens
agcccatcaatatcattga

SEQ ID NO: 1233 - DNA, 19 bp, Homo sapiens
tgtttcaactgcctttgtg

SEQ ID NO: 1234 - DNA, 19 bp, Homo sapiens
tgttttcctatttccaaga

SEQ ID NO: 1235 - DNA, 19 bp, Homo sapiens
agttattttgctaaacttg

SEQ ID NO: 1236 - DNA, 19 bp, Homo sapiens
ctgtttttagaggaaacca

SEQ ID NO: 1237 - DNA, 19 bp, Homo sapiens
tgtatagcaaattcctgtt

SEQ ID NO: 1238 - DNA, 19 bp, Homo sapiens
gttccttccatgatttccc

SEQ ID NO: 1239 - DNA, 19 bp, Homo sapiens
gagacagcatcttcgtgtt

SEQ ID NO: 1240 - DNA, 19 bp, Homo sapiens
ctgctaagaaccttactga

SEQ ID NO: 1241 - DNA, 19 bp, Homo sapiens
cctttcaagcactgactgc

SEQ ID NO: 1242 - DNA, 19 bp, Homo sapiens
ccaggttttccacaccaga

SEQ ID NO: 1243 - DNA, 19 bp, Homo sapiens
ctttttcaccaacggagaa

SEQ ID NO: 1244 - DNA, 19 bp, Homo sapiens
caggaggctttaagttcag

SEQ ID NO: 1245 - DNA, 19 bp, Homo sapiens
attccttcctttacaattg

SEQ ID NO: 1246 - DNA, 19 bp, Homo sapiens
gtcagcccagttccttcca

SEQ ID NO: 1247 - DNA, 19 bp, Homo sapiens
tgggctaaacgtatgaaag

SEQ ID NO: 1248 - DNA, 19 bp, Homo sapiens
atcttcataagttcaatga

SEQ ID NO: 1249 - DNA, 19 bp, Homo sapiens
gagtgaaatgctgtttttt

SEQ ID NO: 1250 - DNA, 19 bp, Homo sapiens
taatgattttcaagttcct

SEQ ID NO: 1251 - DNA, 19 bp, Homo sapiens
acgttagcctctaagacta

SEQ ID NO: 1252 - DNA, 19 bp, Homo sapiens
cttttacaattcattttcc

SEQ ID NO: 1253 - DNA, 19 bp, Homo sapiens
gctttctcttccacatttc

SEQ ID NO: 1254 - DNA, 19 bp, Homo sapiens
attgatgttagagtgcttt

SEQ ID NO: 1255 - DNA, 19 bp, Homo sapiens
tattgatgttagagtgctt

SEQ ID NO: 1256 - DNA, 19 bp, Homo sapiens
tcaaccttaatgattttca

SEQ ID NO: 1257 - DNA, 19 bp, Homo sapiens
caaagccatcactgatgat

SEQ ID NO: 1258 - DNA, 19 bp, Homo sapiens
tgaaatcattgaaaaatta

SEQ ID NO: 1259 - DNA, 19 bp, Homo sapiens
tgaagtagctgagaaaatc

SEQ ID NO: 1260 - DNA, 19 bp, Homo sapiens
aaacattcctttaacaatt

SEQ ID NO: 1261 - DNA, 19 bp, Homo sapiens
tattgaaaatattgatttt

SEQ ID NO: 1262 - DNA, 19 bp, Homo sapiens
atcatatccgtgtaatttt

SEQ ID NO: 1263 - DNA, 19 bp, Homo sapiens
ttaatcttcataagttcaa

SEQ ID NO: 1264 - DNA, 19 bp, Homo sapiens
agcttggttttgccagtct

SEQ ID NO: 1265 - DNA, 19 bp, Homo sapiens
attccttcctttacaattg

SEQ ID NO: 1266 - DNA, 19 bp, Homo sapiens
aattgttgaaagaaaacct

SEQ ID NO: 1267 - DNA, 19 bp, Homo sapiens
ggacaaggcccagaatctg

SEQ ID NO: 1268 - DNA, 19 bp, Homo sapiens
aaagaaaacctatgcctta

SEQ ID NO: 1269 - DNA, 19 bp, Homo sapiens
atttcttaaacattccttt

SEQ ID NO: 1270 - DNA, 19 bp, Homo sapiens
taaagccattcagtctctc

SEQ ID NO: 1271 - DNA, 19 bp, Homo sapiens
gacatgttgataaagaaat

SEQ ID NO: 1272 - DNA, 19 bp, Homo sapiens
atgtatcaaatggacattc

SEQ ID NO: 1273 - DNA, 19 bp, Homo sapiens
atctggaaccttgaagtaa

SEQ ID NO: 1274 - DNA, 19 bp, Homo sapiens
cttttcacattagatgcaa

SEQ ID NO: 1275 - DNA, 19 bp, Homo sapiens
ttgaaggacttcaggaatg

SEQ ID NO: 1276 - DNA, 19 bp, Homo sapiens
ggactcaaggataacgtgt

SEQ ID NO: 1277 - DNA, 19 bp, Homo sapiens
atcttcaatgattatatcc

SEQ ID NO: 1278 - DNA, 19 bp, Homo sapiens
tttatgattatgtcaacaa

SEQ ID NO: 1279 - DNA, 19 bp, Homo sapiens
actggacttctctagtcag

SEQ ID NO: 1280 - DNA, 19 bp, Homo sapiens
gaaaaatgaagtccggatt

SEQ ID NO: 1281 - DNA, 19 bp, Homo sapiens
tttgcaagttaaagaaaat

SEQ ID NO: 1282 - DNA, 19 bp, Homo sapiens
atttgatttaagtgtaaaa

SEQ ID NO: 1283 - DNA, 19 bp, Homo sapiens
tgcaagttaaagaaaatca

SEQ ID NO: 1284 - DNA, 19 bp, Homo sapiens
cattggtaggagacagcat

SEQ ID NO: 1285 - DNA, 19 bp, Homo sapiens
gcattggtaggagacagca

SEQ ID NO: 1286 - DNA, 19 bp, Homo sapiens
agctagagggcctcttttt

SEQ ID NO: 1287 - DNA, 19 bp, Homo sapiens
tccactcacatcctccagt

SEQ ID NO: 1288 - DNA, 19 bp, Homo sapiens
catgaacccctacatgaag

SEQ ID NO: 1289 - DNA, 19 bp, Homo sapiens
atttgaaagttcgttttcc

SEQ ID NO: 1290 - DNA, 19 bp, Homo sapiens
gagaacattatggaggccc

SEQ ID NO: 1291 - DNA, 19 bp, Homo sapiens
gtgtcttcaaagctgagaa

SEQ ID NO: 1292 - DNA, 19 bp, Homo sapiens
attccagcttccccacatc

SEQ ID NO: 1293 - DNA, 19 bp, Homo sapiens
cttatgggatttcctaaag

SEQ ID NO: 1294 - DNA, 19 bp, Homo sapiens
cttcatctgtcattgatgc

SEQ ID NO: 1295 - DNA, 19 bp, Homo sapiens
attccctgaagttgatgtg

SEQ ID NO: 1296 - DNA, 19 bp, Homo sapiens
tccatcacaaatcctttgg

SEQ ID NO: 1297 - DNA, 19 bp, Homo sapiens
ttccatcacaaatcctttg

SEQ ID NO: 1298 - DNA, 19 bp, Homo sapiens
tctcaagagttacagcaga

SEQ ID NO: 1299 - DNA, 19 bp, Homo sapiens
ttctcaagagttacagcag

SEQ ID NO: 1300 - DNA, 19 bp, Homo sapiens
tgggcctgccccagattct

SEQ ID NO: 1301 - DNA, 19 bp, Homo sapiens
gaaatcttcaatttattct

SEQ ID NO: 1302 - DNA, 19 bp, Homo sapiens
tttttgcaagttaaagaaa

SEQ ID NO: 1303 - DNA, 19 bp, Homo sapiens
aaagaaaatcaggatctga

SEQ ID NO: 1304 - DNA, 19 bp, Homo sapiens
atctatgccatctcttctg

SEQ ID NO: 1305 - DNA, 19 bp, Homo sapiens
atggagtctttattgtgta

SEQ ID NO: 1306 - DNA, 19 bp, Homo sapiens
tgagaactacgagctgact

SEQ ID NO: 1307 - DNA, 19 bp, Homo sapiens
actggtggcaaaaccctcc

SEQ ID NO: 1308 - DNA, 19 bp, Homo sapiens
attgaagtacctacttttg

SEQ ID NO: 1309 - DNA, 19 bp, Homo sapiens
aattgaagtacctactttt

SEQ ID NO: 1310 - DNA, 19 bp, Homo sapiens
cattatggcccttcgtgaa

SEQ ID NO: 1311 - DNA, 19 bp, Homo sapiens
tcaaaagaagcccaagagg

SEQ ID NO: 1312 - DNA, 19 bp, Homo sapiens
caagcatctgattgactca

SEQ ID NO: 1313 - DNA, 19 bp, Homo sapiens
cttgaacacaaagtcagtg

SEQ ID NO: 1314 - DNA, 19 bp, Homo sapiens
caaaaacattttcaacttc

SEQ ID NO: 1315 - DNA, 19 bp, Homo sapiens
ccatttacagatcttcagg

SEQ ID NO: 1316 - DNA, 19 bp, Homo sapiens
ctggattccacatgcagct

SEQ ID NO: 1317 - DNA, 19 bp, Homo sapiens
atcatatccgtgtaatttt

SEQ ID NO: 1318 - DNA, 19 bp, Homo sapiens
aaagctgagaagaaatctg

SEQ ID NO: 1319 - DNA, 19 bp, Homo sapiens
caaagctgagaagaaatct

SEQ ID NO: 1320 - DNA, 19 bp, Homo sapiens
atccaagatgagatcaaca

SEQ ID NO: 1321 - DNA, 19 bp, Homo sapiens
caactctctgattactatg

SEQ ID NO: 1322 - DNA, 19 bp, Homo sapiens
cttcaatttattcttcttt

SEQ ID NO: 1323 - DNA, 19 bp, Homo sapiens
cttcaaagacttaaaaaat

SEQ ID NO: 1324 - DNA, 19 bp, Homo sapiens
tctcttcctccatggaatt

SEQ ID NO: 1325 - DNA, 19 bp, Homo sapiens
tcttcataagttcaatgaa

SEQ ID NO: 1326 - DNA, 19 bp, Homo sapiens
ctgttgaaagatttatcaa

SEQ ID NO: 1327 - DNA, 19 bp, Homo sapiens
actcaatggtgaaattcag

SEQ ID NO: 1328 - DNA, 19 bp, Homo sapiens
ttcagaagctaagcaatgt

SEQ ID NO: 1329 - DNA, 19 bp, Homo sapiens
ttttggcaagctatacagt

SEQ ID NO: 1330 - DNA, 19 bp, Homo sapiens
ttgcaagcaagtctttcct

SEQ ID NO: 1331 - DNA, 19 bp, Homo sapiens
ttctctctatgggaaaaaa

SEQ ID NO: 1332 - DNA, 19 bp, Homo sapiens
tgaaatgctgttttttgga

SEQ ID NO: 1333 - DNA, 19 bp, Homo sapiens
agaatctgtaccaggaact

SEQ ID NO: 1334 - DNA, 19 bp, Homo sapiens
acttcagagaaatacaaat

SEQ ID NO: 1335 - DNA, 19 bp, Homo sapiens
tgaaaccaatgacaaaatc

SEQ ID NO: 1336 - DNA, 19 bp, Homo sapiens
cagctgagcagacaggcac

SEQ ID NO: 1337 - DNA, 19 bp, Homo sapiens
cttcataagttcaatgaat

SEQ ID NO: 1338 - DNA, 19 bp, Homo sapiens
acttcccaactctcaagtc

SEQ ID NO: 1339 - DNA, 19 bp, Homo sapiens
ctgggcagctgtatagcaa

SEQ ID NO: 1340 - DNA, 19 bp, Homo sapiens
taagtatgatttcaattct

SEQ ID NO: 1341 - DNA, 19 bp, Homo sapiens
agttcaatgaatttattca

SEQ ID NO: 1342 - DNA, 19 bp, Homo sapiens
cagcccagccatttgagat

SEQ ID NO: 1343 - DNA, 19 bp, Homo sapiens
tcagcccagccatttgaga

SEQ ID NO: 1344 - DNA, 19 bp, Homo sapiens
gatgggaaagccgccctca

SEQ ID NO: 1345 - DNA, 19 bp, Homo sapiens
ttgaaagcagaacctctgg

SEQ ID NO: 1346 - DNA, 19 bp, Homo sapiens
ctttctcgggaatattcag

SEQ ID NO: 1347 - DNA, 19 bp, Homo sapiens
tgacaggcattttgaaaaa

SEQ ID NO: 1348 - DNA, 19 bp, Homo sapiens
ttgacaggcattttgaaaa

SEQ ID NO: 1349 - DNA, 19 bp, Homo sapiens
aattccaattttgagaatg

SEQ ID NO: 1350 - DNA, 19 bp, Homo sapiens
aaatgtcagctcttgttca

SEQ ID NO: 1351 - DNA, 19 bp, Homo sapiens
tgccagtttgaaaaacaaa

SEQ ID NO: 1352 - DNA, 19 bp, Homo sapiens
ttgacatgttgataaagaa

SEQ ID NO: 1353 - DNA, 19 bp, Homo sapiens
tgaagtagaccaacaaatc

SEQ ID NO: 1354 - DNA, 19 bp, Homo sapiens
cttcaggttccatcgtgca

SEQ ID NO: 1355 - DNA, 19 bp, Homo sapiens
atgttgataaagaaattaa

SEQ ID NO: 1356 - DNA, 19 bp, Homo sapiens
attcaaactgcctatattg

SEQ ID NO: 1357 - DNA, 19 bp, Homo sapiens
caagagcacacggtcttca

SEQ ID NO: 1358 - DNA, 19 bp, Homo sapiens
aaattccctgaagttgatg

SEQ ID NO: 1359 - DNA, 19 bp, Homo sapiens
aagtaagtgctaggttcaa

SEQ ID NO: 1360 - DNA, 19 bp, Homo sapiens
ttctgcacagaaatattca

SEQ ID NO: 1361 - DNA, 19 bp, Homo sapiens
gcttgctaacctctctgaa

SEQ ID NO: 1362 - DNA, 19 bp, Homo sapiens
gggacctaccaagagtgga

SEQ ID NO: 1363 - DNA, 19 bp, Homo sapiens
agttcaatgaatttattca

SEQ ID NO: 1364 - DNA, 19 bp, Homo sapiens
gattactatgaaaaattta

SEQ ID NO: 1365 - DNA, 19 bp, Homo sapiens
ttttaaaagaaatcttcaa

SEQ ID NO: 1366 - DNA, 19 bp, Homo sapiens
cgaggccaggccgcagccc

SEQ ID NO: 1367 - DNA, 19 bp, Homo sapiens
ccgaggccaggccgcagcc

SEQ ID NO: 1368 - DNA, 19 bp, Homo sapiens
aaccgtgcctgaatctcag

SEQ ID NO: 1369 - DNA, 19 bp, Homo sapiens
tcagctgacctcatcgaga

SEQ ID NO: 1370 - DNA, 19 bp, Homo sapiens
gctctgcagcttcatcctg

SEQ ID NO: 1371 - DNA, 19 bp, Homo sapiens
cagcacagaccatttcagc

SEQ ID NO: 1372 - DNA, 19 bp, Homo sapiens
ctggatgtaaccaccagca

SEQ ID NO: 1373 - DNA, 19 bp, Homo sapiens
catcctgaagaccagccag

SEQ ID NO: 1374 - DNA, 19 bp, Homo sapiens
actcaccctggacattcag

SEQ ID NO: 1375 - DNA, 19 bp, Homo sapiens
tcccggagccaaggctgga

SEQ ID NO: 1376 - DNA, 19 bp, Homo sapiens
ggaaccctctccctcacct

SEQ ID NO: 1377 - DNA, 19 bp, Homo sapiens
ctgggaggcatgatgctca

SEQ ID NO: 1378 - DNA, 19 bp, Homo sapiens
ttcaaatataatcggcaga

SEQ ID NO: 1379 - DNA, 19 bp, Homo sapiens
tcttccgttctgtaatggc

SEQ ID NO: 1380 - DNA, 19 bp, Homo sapiens
tgcaagaatattttgagag

SEQ ID NO: 1381 - DNA, 19 bp, Homo sapiens
ccagtttccggggaaacct

SEQ ID NO: 1382 - DNA, 19 bp, Homo sapiens
tctttttgggaagcaagga

SEQ ID NO: 1383 - DNA, 19 bp, Homo sapiens
aatggtcaagttcctgatg

SEQ ID NO: 1384 - DNA, 19 bp, Homo sapiens
gtctctgaactcagaagga

SEQ ID NO: 1385 - DNA, 19 bp, Homo sapiens
aacaaataaatggagtctt

SEQ ID NO: 1386 - DNA, 19 bp, Homo sapiens
ccagagccaggtcgagctt

SEQ ID NO: 1387 - DNA, 19 bp, Homo sapiens
tccatgtcccatttacaga

SEQ ID NO: 1388 - DNA, 19 bp, Homo sapiens
ttgattttaacaaaagtgg

SEQ ID NO: 1389 - DNA, 19 bp, Homo sapiens
ttgcaagcaagtctttcct

SEQ ID NO: 1390 - DNA, 19 bp, Homo sapiens
atttccataccccgtttgc

SEQ ID NO: 1391 - DNA, 19 bp, Homo sapiens
tattcttcttttccaattg

SEQ ID NO: 1392 - DNA, 19 bp, Homo sapiens
gtggcttcccatattgcca

SEQ ID NO: 1393 - DNA, 19 bp, Homo sapiens
cacattacatttggtctct

SEQ ID NO: 1394 - DNA, 19 bp, Homo sapiens
tgggaaagccgccctcaca

SEQ ID NO: 1395 - DNA, 19 bp, Homo sapiens
atgggaaagccgccctcac

SEQ ID NO: 1396 - DNA, 19 bp, Homo sapiens
gatgctgaacagtgagctg

SEQ ID NO: 1397 - DNA, 19 bp, Homo sapiens
tcataacagtactgtgagc

SEQ ID NO: 1398 - DNA, 19 bp, Homo sapiens
ctgagtgggtttatcaagg

SEQ ID NO: 1399 - DNA, 19 bp, Homo sapiens
gctgagtgggtttatcaag

SEQ ID NO: 1400 - DNA, 19 bp, Homo sapiens
ttgcaatgagctcatggct

SEQ ID NO: 1401 - DNA, 19 bp, Homo sapiens
gttgcaatgagctcatggc

SEQ ID NO: 1402 - DNA, 19 bp, Homo sapiens
gtaggaataaatggagaag

SEQ ID NO: 1403 - DNA, 19 bp, Homo sapiens
ttattgctgaatccaaaag

SEQ ID NO: 1404 - DNA, 19 bp, Homo sapiens
aaagccatcactgatgatc

SEQ ID NO: 1405 - DNA, 19 bp, Homo sapiens
caaagccatcactgatgat

SEQ ID NO: 1406 - DNA, 19 bp, Homo sapiens
tcacaaatcctttggctgt

SEQ ID NO: 1407 - DNA, 19 bp, Homo sapiens
caaaatagaagggaatctt

SEQ ID NO: 1408 - DNA, 19 bp, Homo sapiens
ctggtaactactttaaaca

SEQ ID NO: 1409 - DNA, 19 bp, Homo sapiens
gttcaatgaatttattcaa

SEQ ID NO: 1410 - DNA, 19 bp, Homo sapiens
atggcattttttgcaagtt

SEQ ID NO: 1411 - DNA, 19 bp, Homo sapiens
agattgatgggcagttcag

SEQ ID NO: 1412 - DNA, 19 bp, Homo sapiens
ctcaaagaatgactttttt

SEQ ID NO: 1413 - DNA, 19 bp, Homo sapiens
tctccagataaaaaactca

SEQ ID NO: 1414 - DNA, 19 bp, Homo sapiens
ctcagatcaaagttaattg

SEQ ID NO: 1415 - DNA, 19 bp, Homo sapiens
gagggtagtcataacagta

SEQ ID NO: 1416 - DNA, 19 bp, Homo sapiens
actgttgactcaggaaggc

SEQ ID NO: 1417 - DNA, 19 bp, Homo sapiens
tggccacatagcatggact

SEQ ID NO: 1418 - DNA, 19 bp, Homo sapiens
cagctgacctcatcgagat

SEQ ID NO: 1419 - DNA, 19 bp, Homo sapiens
tcagctgacctcatcgaga

SEQ ID NO: 1420 - DNA, 19 bp, Homo sapiens
acctgcaccaaagctggca

SEQ ID NO: 1421 - DNA, 19 bp, Homo sapiens
caccaaaaaccccaatggc

SEQ ID NO: 1422 - DNA, 19 bp, Homo sapiens
accagatgctgaacagtga

SEQ ID NO: 1423 - DNA, 19 bp, Homo sapiens
accacttacagctagaggg

SEQ ID NO: 1424 - DNA, 19 bp, Homo sapiens
gggcgacctaagttgtgac

SEQ ID NO: 1425 - DNA, 19 bp, Homo sapiens
tggctggtaacctaaaagg

SEQ ID NO: 1426 - DNA, 19 bp, Homo sapiens
ggtcctttatgattatgtc

SEQ ID NO: 1427 - DNA, 19 bp, Homo sapiens
ttcccaaaagcagtcagca

SEQ ID NO: 1428 - DNA, 19 bp, Homo sapiens
ttcaggtccatgcaagtca

SEQ ID NO: 1429 - DNA, 19 bp, Homo sapiens
tcttgaacacaaagtcagt

SEQ ID NO: 1430 - DNA, 19 bp, Homo sapiens
aaatgaaagtaaagatcat

SEQ ID NO: 1431 - DNA, 19 bp, Homo sapiens
gagtaaaccaaaacttggt

SEQ ID NO: 1432 - DNA, 19 bp, Homo sapiens
gagttactgaaaaagctgc

SEQ ID NO: 1433 - DNA, 19 bp, Homo sapiens
attggatatccaagatctg

SEQ ID NO: 1434 - DNA, 19 bp, Homo sapiens
ccatgacctccagctcctg

SEQ ID NO: 1435 - DNA, 19 bp, Homo sapiens
ctgaaatacaatgctctgg

SEQ ID NO: 1436 - DNA, 19 bp, Homo sapiens
gaaaaacttggaaacaacc

SEQ ID NO: 1437 - DNA, 19 bp, Homo sapiens
agaatccagatacaagaaa

SEQ ID NO: 1438 - DNA, 19 bp, Homo sapiens
cagcatgcctagtttctcc

SEQ ID NO: 1439 - DNA, 19 bp, Homo sapiens
tcaatatcaaaagcccagc

SEQ ID NO: 1440 - DNA, 19 bp, Homo sapiens
atatctggaaccttgaagt

SEQ ID NO: 1441 - DNA, 19 bp, Homo sapiens
ctgaactcagaaggatggc

SEQ ID NO: 1442 - DNA, 19 bp, Homo sapiens
cttccattctgaatatatt

SEQ ID NO: 1443 - DNA, 19 bp, Homo sapiens
gataaaagattactttgag

SEQ ID NO: 1444 - DNA, 19 bp, Homo sapiens
tcttcaatttattcttctt

SEQ ID NO: 1445 - DNA, 19 bp, Homo sapiens
atcttcaatttattcttct

SEQ ID NO: 1446 - DNA, 19 bp, Homo sapiens
ttcacataccagaattcca

SEQ ID NO: 1447 - DNA, 19 bp, Homo sapiens
tttttaaccagtcagatat

SEQ ID NO: 1448 - DNA, 19 bp, Homo sapiens
ctttttaaccagtcagata

SEQ ID NO: 1449 - DNA, 19 bp, Homo sapiens
ctaaattcccatggtcttg

SEQ ID NO: 1450 - DNA, 19 bp, Homo sapiens
actaaattcccatggtctt

SEQ ID NO: 1451 - DNA, 19 bp, Homo sapiens
tctttctcgggaatattca

SEQ ID NO: 1452 - DNA, 19 bp, Homo sapiens
gaagcacatatgaactgga

SEQ ID NO: 1453 - DNA, 19 bp, Homo sapiens
ttcctttaacaattcctga

SEQ ID NO: 1454 - DNA, 19 bp, Homo sapiens
gctgacatagggaatggaa

SEQ ID NO: 1455 - DNA, 19 bp, Homo sapiens
tattctatccaagattggg

SEQ ID NO: 1456 - DNA, 19 bp, Homo sapiens
ttctatccaagattgggct

SEQ ID NO: 1457 - DNA, 19 bp, Homo sapiens
tttgaaaaacaaagcagat

SEQ ID NO: 1458 - DNA, 19 bp, Homo sapiens
attttttgcaagttaaaga

SEQ ID NO: 1459 - DNA, 19 bp, Homo sapiens
gcatggcattatgatgaag

SEQ ID NO: 1460 - DNA, 19 bp, Homo sapiens
ttcagggtgtggagtttag

SEQ ID NO: 1461 - DNA, 19 bp, Homo sapiens
tttcttaaacattccttta

SEQ ID NO: 1462 - DNA, 19 bp, Homo sapiens
ttccctccattaagttctc

SEQ ID NO: 1463 - DNA, 19 bp, Homo sapiens
ttccaatgaccaagaaaag

SEQ ID NO: 1464 - DNA, 19 bp, Homo sapiens
gcttactggacgaactctg

SEQ ID NO: 1465 - DNA, 19 bp, Homo sapiens
caaattcctggatacactg

SEQ ID NO: 1466 - DNA, 19 bp, Homo sapiens
acaagaatacgtctacact

SEQ ID NO: 1467 - DNA, 19 bp, Homo sapiens
acctcggaacaatcctcag

SEQ ID NO: 1468 - DNA, 19 bp, Homo sapiens
gacctgcgcaacgagatca

SEQ ID NO: 1469 - DNA, 19 bp, Homo sapiens
ccatgatctacatttgttt

SEQ ID NO: 1470 - DNA, 19 bp, Homo sapiens
caaaaacattttcaacttc

SEQ ID NO: 1471 - DNA, 19 bp, Homo sapiens
ctttaagttcagcatcttt

SEQ ID NO: 1472 - DNA, 19 bp, Homo sapiens
cagatttgaggattccatc

SEQ ID NO: 1473 - DNA, 19 bp, Homo sapiens
caatcacaagtcgattccc

SEQ ID NO: 1474 - DNA, 19 bp, Homo sapiens
gaagtgtcagtggcaaaaa

SEQ ID NO: 1475 - DNA, 19 bp, Homo sapiens
catggcattatgatgaaga

SEQ ID NO: 1476 - DNA, 19 bp, Homo sapiens
cattatggaggcccatgta

SEQ ID NO: 1477 - DNA, 19 bp, Homo sapiens
caaaatcaactttaatgaa

SEQ ID NO: 1478 - DNA, 19 bp, Homo sapiens
tcaacacaatcttcaatga

SEQ ID NO: 1479 - DNA, 19 bp, Homo sapiens
ctccccaggacctttcaaa

SEQ ID NO: 1480 - DNA, 19 bp, Homo sapiens
gctccccaggacctttcaa

SEQ ID NO: 1481 - DNA, 19 bp, Homo sapiens
agctccccaggacctttca

SEQ ID NO: 1482 - DNA, 19 bp, Homo sapiens
ctgtttctgagtcccagtg

SEQ ID NO: 1483 - DNA, 19 bp, Homo sapiens
actgtttctgagtcccagt

SEQ ID NO: 1484 - DNA, 19 bp, Homo sapiens
gatgatgccaaaatcaact

SEQ ID NO: 1485 - DNA, 19 bp, Homo sapiens
agatgatgccaaaatcaac

SEQ ID NO: 1486 - DNA, 19 bp, Homo sapiens
actcagaaggatggcattt

SEQ ID NO: 1487 - DNA, 19 bp, Homo sapiens
ttggttacaggaggcttta

SEQ ID NO: 1488 - DNA, 19 bp, Homo sapiens
ttttcttttcagcccagcc

SEQ ID NO: 1489 - DNA, 19 bp, Homo sapiens
attttcaagcaaatgcaca

SEQ ID NO: 1490 - DNA, 19 bp, Homo sapiens
atgcgtctaccttacacaa

SEQ ID NO: 1491 - DNA, 19 bp, Homo sapiens
ggaagctgaagtttatcat

SEQ ID NO: 1492 - DNA, 19 bp, Homo sapiens
cagagctatcactgggaag

SEQ ID NO: 1493 - DNA, 19 bp, Homo sapiens
gagcttactggacgaactc

SEQ ID NO: 1494 - DNA, 19 bp, Homo sapiens
cagcctccccagccgtagg

SEQ ID NO: 1495 - DNA, 19 bp, Homo sapiens
aaactgttaatttacagct

SEQ ID NO: 1496 - DNA, 19 bp, Homo sapiens
agtttccggggaaacctgg

SEQ ID NO: 1497 - DNA, 19 bp, Homo sapiens
tacagtattctgaaaatcc

SEQ ID NO: 1498 - DNA, 19 bp, Homo sapiens
aatgagctcatggcttcag

SEQ ID NO: 1499 - DNA, 19 bp, Homo sapiens
attttgagaggaatcgaca

SEQ ID NO: 1500 - DNA, 19 bp, Homo sapiens
aacacatgaatcacaaatt

SEQ ID NO: 1501 - DNA, 19 bp, Homo sapiens
tcaaaacgagcttcaggaa

SEQ ID NO: 1502 - DNA, 19 bp, Homo sapiens
aacttgtacaactggtccg

SEQ ID NO: 1503 - DNA, 19 bp, Homo sapiens
tcatcaattggttacagga

SEQ ID NO: 1504 - DNA, 19 bp, Homo sapiens
tctgcagaacaatgctgag

SEQ ID NO: 1505 - DNA, 19 bp, Homo sapiens
aattgactttgtagaaatg

SEQ ID NO: 1506 - DNA, 19 bp, Homo sapiens
ccatgcaagtcagcccagt

SEQ ID NO: 1507 - DNA, 19 bp, Homo sapiens
aaactgcctatattgataa

SEQ ID NO: 1508 - DNA, 19 bp, Homo sapiens
ctggacttctcttcaaaac

SEQ ID NO: 1509 - DNA, 19 bp, Homo sapiens
tctgggtgtcgacagcaaa

SEQ ID NO: 1510 - DNA, 19 bp, Homo sapiens
ttctgggtgtcgacagcaa

SEQ ID NO: 1511 - DNA, 19 bp, Homo sapiens
agtcaagattgatgggcag

SEQ ID NO: 1512 - DNA, 19 bp, Homo sapiens
ggaggctttaagttcagca

SEQ ID NO: 1513 - DNA, 19 bp, Homo sapiens
ctgtatagcaaattcctgt

SEQ ID NO: 1514 - DNA, 19 bp, Homo sapiens
catggacttcttctggaaa

SEQ ID NO: 1515 - DNA, 19 bp, Homo sapiens
tgcccagcaagcaagttgg

SEQ ID NO: 1516 - DNA, 19 bp, Homo sapiens
catccttaacaccttccac

SEQ ID NO: 1517 - DNA, 19 bp, Homo sapiens
ttcactgttcctgaaatca

SEQ ID NO: 1518 - DNA, 19 bp, Homo sapiens
caaaaacattttcaacttc

SEQ ID NO: 1519 - DNA, 19 bp, Homo sapiens
attcataatcccaactctc

SEQ ID NO: 1520 - DNA, 19 bp, Homo sapiens
tgcctttgtgtacaccaaa

SEQ ID NO: 1521 - DNA, 19 bp, Homo sapiens
ggtaacctaaaaggagcct

SEQ ID NO: 1522 - DNA, 19 bp, Homo sapiens
attgaagtacctacttttg

SEQ ID NO: 1523 - DNA, 19 bp, Homo sapiens
aattgaagtacctactttt

SEQ ID NO: 1524 - DNA, 19 bp, Homo sapiens
aaatccaatctcctctttt

SEQ ID NO: 1525 - DNA, 19 bp, Homo sapiens
gtctgtgggattccatctg

SEQ ID NO: 1526 - DNA, 19 bp, Homo sapiens
tcataagttcaatgaattt

SEQ ID NO: 1527 - DNA, 19 bp, Homo sapiens
ccattgaccagatgctgaa

SEQ ID NO: 1528 - DNA, 19 bp, Homo sapiens
tggaaatgggcctgcccca

SEQ ID NO: 1529 - DNA, 19 bp, Homo sapiens
aatcacaactcctccactg

SEQ ID NO: 1530 - DNA, 19 bp, Homo sapiens
caaaactaccacacatttc

SEQ ID NO: 1531 - DNA, 19 bp, Homo sapiens
tttgagaggaatcgacaaa

SEQ ID NO: 1532 - DNA, 19 bp, Homo sapiens
catcaattggttacaggag

SEQ ID NO: 1533 - DNA, 19 bp, Homo sapiens
agtccttcatgtccctaga

SEQ ID NO: 1534 - DNA, 19 bp, Homo sapiens
ggcattttgaaaaaaacag

SEQ ID NO: 1535 - DNA, 19 bp, Homo sapiens
aactctcaaaccctaagat

SEQ ID NO: 1536 - DNA, 19 bp, Homo sapiens
ggacattcctctagcgaga

SEQ ID NO: 1537 - DNA, 19 bp, Homo sapiens
aatgaatacagccaggact

SEQ ID NO: 1538 - DNA, 19 bp, Homo sapiens
actttgtagaaatgaaagt

SEQ ID NO: 1539 - DNA, 19 bp, Homo sapiens
ttgaaggacttcaggaatg

SEQ ID NO: 1540 - DNA, 19 bp, Homo sapiens
gagtaaaccaaaacttggt

SEQ ID NO: 1541 - DNA, 19 bp, Homo sapiens
cctttaacaattcctgaaa

SEQ ID NO: 1542 - DNA, 19 bp, Homo sapiens
tcattctgggtctttccag

SEQ ID NO: 1543 - DNA, 19 bp, Homo sapiens
tagaattacagaaaatgat

SEQ ID NO: 1544 - DNA, 19 bp, Homo sapiens
cgtaggcaccgtgggcatg

SEQ ID NO: 1545 - DNA, 19 bp, Homo sapiens
ttgatgatgctgtcaagaa

SEQ ID NO: 1546 - DNA, 19 bp, Homo sapiens
cagaattccagcttcccca

SEQ ID NO: 1547 - DNA, 19 bp, Homo sapiens
ttgaggctattgatgttag

SEQ ID NO: 1548 - DNA, 19 bp, Homo sapiens
attgaggctattgatgtta

SEQ ID NO: 1549 - DNA, 19 bp, Homo sapiens
cattgaggctattgatgtt

SEQ ID NO: 1550 - DNA, 19 bp, Homo sapiens
tctccatctgcgctaccag

SEQ ID NO: 1551 - DNA, 19 bp, Homo sapiens
tcatctcctttcttcatct

SEQ ID NO: 1552 - DNA, 19 bp, Homo sapiens
cagatatatatctcaggga

SEQ ID NO: 1553 - DNA, 19 bp, Homo sapiens
tcaggctcttcagaaagct

SEQ ID NO: 1554 - DNA, 19 bp, Homo sapiens
tgtcaagataaacaatcag

SEQ ID NO: 1555 - DNA, 19 bp, Homo sapiens
gaagtagtactgcatcttg

SEQ ID NO: 1556 - DNA, 19 bp, Homo sapiens
ctgagtcccagtgcccagc

SEQ ID NO: 1557 - DNA, 19 bp, Homo sapiens
cagcaagtacctgagaacg

SEQ ID NO: 1558 - DNA, 19 bp, Homo sapiens
actcagatcaaagttaatt

SEQ ID NO: 1559 - DNA, 19 bp, Homo sapiens
agcacagtacgaaaaacca

SEQ ID NO: 1560 - DNA, 19 bp, Homo sapiens
tgtccctagaaatctcaag

SEQ ID NO: 1561 - DNA, 19 bp, Homo sapiens
atgtccctagaaatctcaa

SEQ ID NO: 1562 - DNA, 19 bp, Homo sapiens
gatggaaccctctccctca

SEQ ID NO: 1563 - DNA, 19 bp, Homo sapiens
aggaaactcagatcaaagt

SEQ ID NO: 1564 - DNA, 19 bp, Homo sapiens
agcagccagtggcaccact

SEQ ID NO: 1565 - DNA, 19 bp, Homo sapiens
tcagccaggtttatagcac

SEQ ID NO: 1566 - DNA, 19 bp, Homo sapiens
aatttctgattaccaccag

SEQ ID NO: 1567 - DNA, 19 bp, Homo sapiens
tgttttttggaaatgccat

SEQ ID NO: 1568 - DNA, 19 bp, Homo sapiens
ctttgacaggcattttgaa

SEQ ID NO: 1569 - DNA, 19 bp, Homo sapiens
tcgatgcacatacaaatgg

SEQ ID NO: 1570 - DNA, 19 bp, Homo sapiens
ttgatgttagagtgctttt

SEQ ID NO: 1571 - DNA, 19 bp, Homo sapiens
tgtcctacaacaagttaag

SEQ ID NO: 1572 - DNA, 19 bp, Homo sapiens
atgtcctacaacaagttaa

SEQ ID NO: 1573 - DNA, 19 bp, Homo sapiens
agcatctttggctcacatg

SEQ ID NO: 1574 - DNA, 19 bp, Homo sapiens
atttatcaaaagaagccca

SEQ ID NO: 1575 - DNA, 19 bp, Homo sapiens
ttttggcaagctatacagt

SEQ ID NO: 1576 - DNA, 19 bp, Homo sapiens
tcaattgggagagacaagt

SEQ ID NO: 1577 - DNA, 19 bp, Homo sapiens
tgctttgtgagtttatcag

SEQ ID NO: 1578 - DNA, 19 bp, Homo sapiens
cagtcatgtagaaaaactt

SEQ ID NO: 1579 - DNA, 19 bp, Homo sapiens
tgtactggaaaacgtacag

SEQ ID NO: 1580 - DNA, 19 bp, Homo sapiens
aatattgatcaatttgtaa

SEQ ID NO: 1581 - DNA, 19 bp, Homo sapiens
gtttgaaaaacaaagcaga

SEQ ID NO: 1582 - DNA, 19 bp, Homo sapiens
tttcatttgaaagaataaa

SEQ ID NO: 1583 - DNA, 19 bp, Homo sapiens
atttcaagcaagaacttaa

SEQ ID NO: 1584 - DNA, 19 bp, Homo sapiens
attggcgtggagcttactg

SEQ ID NO: 1585 - DNA, 19 bp, Homo sapiens
ttttgctggagaagccaca

SEQ ID NO: 1586 - DNA, 19 bp, Homo sapiens
ctttgcactatgttcataa

SEQ ID NO: 1587 - DNA, 19 bp, Homo sapiens
aaacacctaagagtaaacc

SEQ ID NO: 1588 - DNA, 19 bp, Homo sapiens
aaatgctgacatagggaat

SEQ ID NO: 1589 - DNA, 19 bp, Homo sapiens
gaaatattatgaacttgaa

SEQ ID NO: 1590 - DNA, 19 bp, Homo sapiens
tttcctaaagctggatgta

SEQ ID NO: 1591 - DNA, 19 bp, Homo sapiens
caggtccatgcaagtcagc

SEQ ID NO: 1592 - DNA, 19 bp, Homo sapiens
ccagcttccccacatctca

SEQ ID NO: 1593 - DNA, 19 bp, Homo sapiens
tcttcgtgtttcaactgcc

SEQ ID NO: 1594 - DNA, 19 bp, Homo sapiens
caagtaagtgctaggttca

SEQ ID NO: 1595 - DNA, 19 bp, Homo sapiens
ccaacacttacttgaattc

SEQ ID NO: 1596 - DNA, 19 bp, Homo sapiens
tcagaaagctaccttccag

SEQ ID NO: 1597 - DNA, 19 bp, Homo sapiens
atggacttcttctggaaaa

SEQ ID NO: 1598 - DNA, 19 bp, Homo sapiens
ctcatctcctttcttcatc

SEQ ID NO: 1599 - DNA, 19 bp, Homo sapiens
cttttctaaacttgaaatt

SEQ ID NO: 1600 - DNA, 19 bp, Homo sapiens
ttatgaacttgaagaaaag

SEQ ID NO: 1601 - DNA, 19 bp, Homo sapiens
ttttcacattagatgcaaa

SEQ ID NO: 1602 - DNA, 19 bp, Homo sapiens
aaaattgatgatatctgga

SEQ ID NO: 1603 - DNA, 19 bp, Homo sapiens
aaaagggtcatggaaatgg

SEQ ID NO: 1604 - DNA, 19 bp, Homo sapiens
ctcaattttgattttcaag

SEQ ID NO: 1605 - DNA, 19 bp, Homo sapiens
attccctccattaagttct

SEQ ID NO: 1606 - DNA, 19 bp, Homo sapiens
tttcaagcaagaacttaat

SEQ ID NO: 1607 - DNA, 19 bp, Homo sapiens
atcagttcagataaacttc

SEQ ID NO: 1608 - DNA, 19 bp, Homo sapiens
aattccctgaagttgatgt

SEQ ID NO: 1609 - DNA, 19 bp, Homo sapiens
gctttctcttccacatttc

SEQ ID NO: 1610 - DNA, 19 bp, Homo sapiens
cccatttacagatcttcag

SEQ ID NO: 1611 - DNA, 19 bp, Homo sapiens
tcccatttacagatcttca

SEQ ID NO: 1612 - DNA, 19 bp, Homo sapiens
tttgaggattccatcagtt

SEQ ID NO: 1613 - DNA, 19 bp, Homo sapiens
tctggctccctcaactttt

SEQ ID NO: 1614 - DNA, 19 bp, Homo sapiens
gtttattgaaaatattgat

SEQ ID NO: 1615 - DNA, 19 bp, Homo sapiens
aatattattgatgaaatca

SEQ ID NO: 1616 - DNA, 19 bp, Homo sapiens
gcaagaacttaatggaaat

SEQ ID NO: 1617 - DNA, 19 bp, Homo sapiens
catcacactgaataccaat

SEQ ID NO: 1618 - DNA, 19 bp, Homo sapiens
caagagcttatgggatttc

SEQ ID NO: 1619 - DNA, 19 bp, Homo sapiens
attactttgagaaattagt

SEQ ID NO: 1620 - DNA, 19 bp, Homo sapiens
acttgacttcagagaaata

SEQ ID NO: 1621 - DNA, 19 bp, Homo sapiens
gtcttcagtgaagctgcag

SEQ ID NO: 1622 - DNA, 19 bp, Homo sapiens
agcctcacctcttactttt

SEQ ID NO: 1623 - DNA, 19 bp, Homo sapiens
aagtagctgagaaaatcaa

SEQ ID NO: 1624 - DNA, 19 bp, Homo sapiens
ttttcacattagatgcaaa

SEQ ID NO: 1625 - DNA, 19 bp, Homo sapiens
ggtggactcttgctgctaa

SEQ ID NO: 1626 - DNA, 19 bp, Homo sapiens
ttctcaattttgattttca

SEQ ID NO: 1627 - DNA, 19 bp, Homo sapiens
ttagccacagctctgtctc

SEQ ID NO: 1628 - DNA, 19 bp, Homo sapiens
tcaagaagcttaatgaatt

SEQ ID NO: 1629 - DNA, 19 bp, Homo sapiens
aaaacgagcttcaggaagc

SEQ ID NO: 1630 - DNA, 19 bp, Homo sapiens
atgtcctacaacaagttaa

SEQ ID NO: 1631 - DNA, 19 bp, Homo sapiens
aatcctttgacaggcattt

SEQ ID NO: 1632 - DNA, 19 bp, Homo sapiens
tgaaattcaatcacaagtc

SEQ ID NO: 1633 - DNA, 19 bp, Homo sapiens
gttctcaattttgattttc

SEQ ID NO: 1634 - DNA, 19 bp, Homo sapiens
ttcaggaactattgctagt

SEQ ID NO: 1635 - DNA, 19 bp, Homo sapiens
atgatttccctgaccttgg

SEQ ID NO: 1636 - DNA, 19 bp, Homo sapiens
ttgaagtaaaagaaaattt

SEQ ID NO: 1637 - DNA, 19 bp, Homo sapiens
caaatctggatttcttaaa

SEQ ID NO: 1638 - DNA, 19 bp, Homo sapiens
caagggttcactgttcctg

SEQ ID NO: 1639 - DNA, 19 bp, Homo sapiens
gattctcagatgagggaac

SEQ ID NO: 1640 - DNA, 19 bp, Homo sapiens
cttgaacacaaagtcagtg

SEQ ID NO: 1641 - DNA, 19 bp, Homo sapiens
tcttgaacacaaagtcagt

SEQ ID NO: 1642 - DNA, 19 bp, Homo sapiens
actgttgactcaggaaggc

SEQ ID NO: 1643 - DNA, 19 bp, Homo sapiens
ggaagcttctcaagagtta

SEQ ID NO: 1644 - DNA, 19 bp, Homo sapiens
aaatttctctgctggaaac

SEQ ID NO: 1645 - DNA, 19 bp, Homo sapiens
atctgcagaacaatgctga

SEQ ID NO: 1646 - DNA, 19 bp, Homo sapiens
ggcagcttctggcttgcta

SEQ ID NO: 1647 - DNA, 19 bp, Homo sapiens
aactgttgactcaggaagg

SEQ ID NO: 1648 - DNA, 19 bp, Homo sapiens
agctgccagtccttcatgt

SEQ ID NO: 1649 - DNA, 19 bp, Homo sapiens
cattaatcctgccatcatt

SEQ ID NO: 1650 - DNA, 19 bp, Homo sapiens
ccatttgagatcacggcat

SEQ ID NO: 1651 - DNA, 19 bp, Homo sapiens
ttcgttttccattaaggtt

SEQ ID NO: 1652 - DNA, 19 bp, Homo sapiens
ggaagtggccctgaatgct

SEQ ID NO: 1653 - DNA, 19 bp, Homo sapiens
agggaaagagaagattgca

SEQ ID NO: 1654 - DNA, 19 bp, Homo sapiens
gagaacttactatcatcct

SEQ ID NO: 1655 - DNA, 19 bp, Homo sapiens
tcaatgaatttattcaaaa

SEQ ID NO: 1656 - DNA, 19 bp, Homo sapiens
tcttttcagcccagccatt

SEQ ID NO: 1657 - DNA, 19 bp, Homo sapiens
gctgactttaaaatctgac

SEQ ID NO: 1658 - DNA, 19 bp, Homo sapiens
gggatttcctaaagctgga

SEQ ID NO: 1659 - DNA, 19 bp, Homo sapiens
ccagtttccagggactcaa

SEQ ID NO: 1660 - DNA, 19 bp, Homo sapiens
aagtcgattcccagcatgt

SEQ ID NO: 1661 - DNA, 19 bp, Homo sapiens
tcagatggaaaaatgaagt

SEQ ID NO: 1662 - DNA, 19 bp, Homo sapiens
gaaagtccataatggttca

SEQ ID NO: 1663 - DNA, 19 bp, Homo sapiens
ggaagaagaggcagcttct

SEQ ID NO: 1664 - DNA, 19 bp, Homo sapiens
atctaaatgcagtagccaa

SEQ ID NO: 1665 - DNA, 19 bp, Homo sapiens
attgataaaaccatacagt

SEQ ID NO: 1666 - DNA, 19 bp, Homo sapiens
tattgataaaaccatacag

SEQ ID NO: 1667 - DNA, 19 bp, Homo sapiens
gggaatctgatgaggaaac

SEQ ID NO: 1668 - DNA, 19 bp, Homo sapiens
ttgagttgcccaccatcat

SEQ ID NO: 1669 - DNA, 19 bp, Homo sapiens
caagatcgcagactttgag

SEQ ID NO: 1670 - DNA, 19 bp, Homo sapiens
aacagaaacaatgcattag

SEQ ID NO: 1671 - DNA, 19 bp, Homo sapiens
ccaagaaaaggcacacctt

SEQ ID NO: 1672 - DNA, 19 bp, Homo sapiens
ccctaacagatttgaggat

SEQ ID NO: 1673 - DNA, 19 bp, Homo sapiens
aaacaaacacaggcattcc

SEQ ID NO: 1674 - DNA, 19 bp, Homo sapiens
gaaatactgttttcctatt

SEQ ID NO: 1675 - DNA, 19 bp, Homo sapiens
ataaactgcaagatttttc

SEQ ID NO: 1676 - DNA, 19 bp, Homo sapiens
gctttccaatgaccaagaa

SEQ ID NO: 1677 - DNA, 19 bp, Homo sapiens
ctgtgctttgtgagtttat

SEQ ID NO: 1678 - DNA, 19 bp, Homo sapiens
gaatttgaaagttcgtttt

SEQ ID NO: 1679 - DNA, 19 bp, Homo sapiens
aggaagtggccctgaatgc

SEQ ID NO: 1680 - DNA, 19 bp, Homo sapiens
tgttgaaagatttatcaaa

SEQ ID NO: 1681 - DNA, 19 bp, Homo sapiens
gacaagaaaaaggggattg

SEQ ID NO: 1682 - DNA, 19 bp, Homo sapiens
ctgagaacttcatcatttg

SEQ ID NO: 1683 - DNA, 19 bp, Homo sapiens
ctggacttctctagtcagg

SEQ ID NO: 1684 - DNA, 19 bp, Homo sapiens
tgaatctggctccctcaac

SEQ ID NO: 1685 - DNA, 19 bp, Homo sapiens
agaatccagatacaagaaa

SEQ ID NO: 1686 - DNA, 19 bp, Homo sapiens
cagaatccagatacaagaa

SEQ ID NO: 1687 - DNA, 19 bp, Homo sapiens
ggacagtgaaatattatga

SEQ ID NO: 1688 - DNA, 19 bp, Homo sapiens
ctggatgtaaccaccagca

SEQ ID NO: 1689 - DNA, 19 bp, Homo sapiens
atgaagcttgctccaggag

SEQ ID NO: 1690 - DNA, 19 bp, Homo sapiens
ctgcgctaccagaaagaca

SEQ ID NO: 1691 - DNA, 19 bp, Homo sapiens
tttgagttgcccaccatca

SEQ ID NO: 1692 - DNA, 19 bp, Homo sapiens
gttgaccacaagcttagct

SEQ ID NO: 1693 - DNA, 19 bp, Homo sapiens
caaagctggcaccagggct

SEQ ID NO: 1694 - DNA, 19 bp, Homo sapiens
gcttcaggaagcttctcaa

SEQ ID NO: 1695 - DNA, 19 bp, Homo sapiens
aggaaggccaagccagttt

SEQ ID NO: 1696 - DNA, 19 bp, Homo sapiens
atgattatgtcaacaagta

SEQ ID NO: 1697 - DNA, 19 bp, Homo sapiens
ctgacatcttaggcactga

SEQ ID NO: 1698 - DNA, 19 bp, Homo sapiens
gaactcagaaggatggcat

SEQ ID NO: 1699 - DNA, 19 bp, Homo sapiens
ttctcaattttgattttca

SEQ ID NO: 1700 - DNA, 19 bp, Homo sapiens
ttttctaaatggaacttct

SEQ ID NO: 1701 - DNA, 19 bp, Homo sapiens
ggatctaaatgcagtagcc

SEQ ID NO: 1702 - DNA, 19 bp, Homo sapiens
atttcttaaacattccttt

SEQ ID NO: 1703 - DNA, 19 bp, Homo sapiens
gaatctggctccctcaact

SEQ ID NO: 1704 - DNA, 19 bp, Homo sapiens
tcattctgggtctttccag

SEQ ID NO: 1705 - DNA, 19 bp, Homo sapiens
atagcatggacttcttctg

SEQ ID NO: 1706 - DNA, 19 bp, Homo sapiens
cttctggcttgctaacctc

SEQ ID NO: 1707 - DNA, 19 bp, Homo sapiens
cacggagttactgaaaaag

SEQ ID NO: 1708 - DNA, 19 bp, Homo sapiens
aaggcatctccacctcagc

SEQ ID NO: 1709 - DNA, 19 bp, Homo sapiens
tccaagatgagatcaacac

SEQ ID NO: 1710 - DNA, 19 bp, Homo sapiens
gttgagaagccccaagaat

SEQ ID NO: 1711 - DNA, 19 bp, Homo sapiens
aaattctcttttcttttca

SEQ ID NO: 1712 - DNA, 19 bp, Homo sapiens
tgaaagtcaagcatctgat

SEQ ID NO: 1713 - DNA, 19 bp, Homo sapiens
catccttaacaccttccac

SEQ ID NO: 1714 - DNA, 19 bp, Homo sapiens
tgtaccataagccatattt

SEQ ID NO: 1715 - DNA, 19 bp, Homo sapiens
ttgatgttagagtgctttt

SEQ ID NO: 1716 - DNA, 19 bp, Homo sapiens
tctgcacagaaatattcag

SEQ ID NO: 1717 - DNA, 19 bp, Homo sapiens
taaatggagtctttattgt

SEQ ID NO: 1718 - DNA, 19 bp, Homo sapiens
ataaatggagtctttattg

SEQ ID NO: 1719 - DNA, 19 bp, Homo sapiens
atattgtcagtgcctctaa

SEQ ID NO: 1720 - DNA, 19 bp, Homo sapiens
attactatgaaaaatttat

SEQ ID NO: 1721 - DNA, 19 bp, Homo sapiens
gttattttgctaaacttgg

SEQ ID NO: 1722 - DNA, 19 bp, Homo sapiens
tcatcctctaattttttaa

SEQ ID NO: 1723 - DNA, 19 bp, Homo sapiens
tttcatttgaaagaataaa

SEQ ID NO: 1724 - DNA, 19 bp, Homo sapiens
gaataccaatgctgaactt

SEQ ID NO: 1725 - DNA, 19 bp, Homo sapiens
ctgagagaagtgtcttcaa

SEQ ID NO: 1726 - DNA, 19 bp, Homo sapiens
atatctggaaccttgaagt

SEQ ID NO: 1727 - DNA, 19 bp, Homo sapiens
attccctgaagttgatgtg

SEQ ID NO: 1728 - DNA, 19 bp, Homo sapiens
atttttattcctgccatgg

SEQ ID NO: 1729 - DNA, 19 bp, Homo sapiens
aaaattcaaactgcctata

SEQ ID NO: 1730 - DNA, 19 bp, Homo sapiens
atttgtaagaaaatacaga

SEQ ID NO: 1731 - DNA, 19 bp, Homo sapiens
cagcatgcctagtttctcc

SEQ ID NO: 1732 - DNA, 19 bp, Homo sapiens
tctcctttcttcatcttca

SEQ ID NO: 1733 - DNA, 19 bp, Homo sapiens
ttggtagagcaagggttca

SEQ ID NO: 1734 - DNA, 19 bp, Homo sapiens
cctcctacagtggtggcaa

SEQ ID NO: 1735 - DNA, 19 bp, Homo sapiens
tgaaaacgacaaagcaatc

SEQ ID NO: 1736 - DNA, 19 bp, Homo sapiens
acttttctaaacttgaaat

SEQ ID NO: 1737 - DNA, 19 bp, Homo sapiens
tcagcccagccatttgaga

SEQ ID NO: 1738 - DNA, 19 bp, Homo sapiens
gctggatgtaaccaccagc

SEQ ID NO: 1739 - DNA, 19 bp, Homo sapiens
catcagaaccattgaccag

SEQ ID NO: 1740 - DNA, 19 bp, Homo sapiens
actcaatggtgaaattcag

SEQ ID NO: 1741 - DNA, 19 bp, Homo sapiens
cctcacttcctttggactg

SEQ ID NO: 1742 - DNA, 19 bp, Homo sapiens
tgcaaacttgacttcagag

SEQ ID NO: 1743 - DNA, 19 bp, Homo sapiens
atgacgttcttgagcatgt

SEQ ID NO: 1744 - DNA, 19 bp, Homo sapiens
actggacttctctagtcag

SEQ ID NO: 1745 - DNA, 19 bp, Homo sapiens
atgcctacgttccatgtcc

SEQ ID NO: 1746 - DNA, 19 bp, Homo sapiens
gagaagtgtcttcaaagct

SEQ ID NO: 1747 - DNA, 19 bp, Homo sapiens
gagatcaacacaatcttca

SEQ ID NO: 1748 - DNA, 19 bp, Homo sapiens
ctgaattactgcacctcag

SEQ ID NO: 1749 - DNA, 19 bp, Homo sapiens
ttggtagagcaagggttca

SEQ ID NO: 1750 - DNA, 19 bp, Homo sapiens
tggcactgtttggagaagg

SEQ ID NO: 1751 - DNA, 19 bp, Homo sapiens
gcaagtcagcccagttcct

SEQ ID NO: 1752 - DNA, 19 bp, Homo sapiens
atgaaaccaatgacaaaat

SEQ ID NO: 1753 - DNA, 19 bp, Homo sapiens
tgaaatacaatgctctgga

SEQ ID NO: 1754 - DNA, 19 bp, Homo sapiens
gaaataccaagtcaaaacc

SEQ ID NO: 1755 - DNA, 19 bp, Homo sapiens
tgaaaaagctgcaatcaac

SEQ ID NO: 1756 - DNA, 19 bp, Homo sapiens
aactgcttctccaaatgga

SEQ ID NO: 1757 - DNA, 19 bp, Homo sapiens
agaattcataatcccaact

SEQ ID NO: 1758 - DNA, 19 bp, Homo sapiens
caaaacctactgtctcttc

SEQ ID NO: 1759 - DNA, 19 bp, Homo sapiens
cttcacataccagaattcc

SEQ ID NO: 1760 - DNA, 19 bp, Homo sapiens
aacaaacacaggcattcca

SEQ ID NO: 1761 - DNA, 19 bp, Homo sapiens
cttcatgtccctagaaatc

SEQ ID NO: 1762 - DNA, 19 bp, Homo sapiens
cttcagcctgctttctgga

SEQ ID NO: 1763 - DNA, 19 bp, Homo sapiens
cattagagctgccagtcct

SEQ ID NO: 1764 - DNA, 19 bp, Homo sapiens
tgaagatgacgacttttct

SEQ ID NO: 1765 - DNA, 19 bp, Homo sapiens
tgccagtttgaaaaacaaa

SEQ ID NO: 1766 - DNA, 19 bp, Homo sapiens
aatgtcagctcttgttcag

SEQ ID NO: 1767 - DNA, 19 bp, Homo sapiens
tcatttgccctcaacctac

SEQ ID NO: 1768 - DNA, 19 bp, Homo sapiens
gggaactgttgaaagattt

SEQ ID NO: 1769 - DNA, 19 bp, Homo sapiens
caggagaacttactatcat

SEQ ID NO: 1770 - DNA, 19 bp, Homo sapiens
aactcctccactgaaagat

SEQ ID NO: 1771 - DNA, 19 bp, Homo sapiens
acttccgtttaccagaaat

SEQ ID NO: 1772 - DNA, 19 bp, Homo sapiens
cagagctttctgccactgc

SEQ ID NO: 1773 - DNA, 19 bp, Homo sapiens
aaattcaaactgcctatat

SEQ ID NO: 1774 - DNA, 19 bp, Homo sapiens
aaatacttccacaaattga

SEQ ID NO: 1775 - DNA, 19 bp, Homo sapiens
attgaacatccccaaactg

SEQ ID NO: 1776 - DNA, 19 bp, Homo sapiens
tttcaactgcctttgtgta

SEQ ID NO: 1777 - DNA, 19 bp, Homo sapiens
ttattgctgaatccaaaag

SEQ ID NO: 1778 - DNA, 19 bp, Homo sapiens
ttttcaagcaaatgcacaa

SEQ ID NO: 1779 - DNA, 19 bp, Homo sapiens
aaaagaaaattttgctgga

SEQ ID NO: 1780 - DNA, 19 bp, Homo sapiens
tgaagtagaccaacaaatc

SEQ ID NO: 1781 - DNA, 19 bp, Homo sapiens
aaactaaatgatctaaatt

SEQ ID NO: 1782 - DNA, 19 bp, Homo sapiens
gcaatttctgcacagaaat

SEQ ID NO: 1783 - DNA, 19 bp, Homo sapiens
aaagccattcagtctctca

SEQ ID NO: 1784 - DNA, 19 bp, Homo sapiens
aattccatatgaaagtcaa

SEQ ID NO: 1785 - DNA, 19 bp, Homo sapiens
agaatattttgatccaagt

SEQ ID NO: 1786 - DNA, 19 bp, Homo sapiens
aaatctggatttcttaaac

SEQ ID NO: 1787 - DNA, 19 bp, Homo sapiens
aaataaatggagtctttat

SEQ ID NO: 1788 - DNA, 19 bp, Homo sapiens
ctcagttaactgtgtcccg

SEQ ID NO: 1789 - DNA, 19 bp, Homo sapiens
agcatctgattgactcact

SEQ ID NO: 1790 - DNA, 19 bp, Homo sapiens
gctgattgaggtgtccagc

SEQ ID NO: 1791 - DNA, 19 bp, Homo sapiens
ctggatcacagagtccctc

SEQ ID NO: 1792 - DNA, 19 bp, Homo sapiens
ggccctgatccccgagccc

SEQ ID NO: 1793 - DNA, 19 bp, Homo sapiens
ctcccggagccaaggctgg

SEQ ID NO: 1794 - DNA, 19 bp, Homo sapiens
gctgttttgaagactctcc

SEQ ID NO: 1795 - DNA, 19 bp, Homo sapiens
tttcaagttcctgaccttc

SEQ ID NO: 1796 - DNA, 19 bp, Homo sapiens
aatcttattggggattttg

SEQ ID NO: 1797 - DNA, 19 bp, Homo sapiens
cttccacatttcaaggaat

SEQ ID NO: 1798 - DNA, 19 bp, Homo sapiens
ccagcaagtacctgagaac

SEQ ID NO: 1799 - DNA, 19 bp, Homo sapiens
acttgaagaaaagatagtc

SEQ ID NO: 1800 - DNA, 19 bp, Homo sapiens
cagtgaagctgcagggcac

SEQ ID NO: 1801 - DNA, 19 bp, Homo sapiens
ctcacctccacctctgatc

SEQ ID NO: 1802 - DNA, 19 bp, Homo sapiens
tccactcacatcctccagt

SEQ ID NO: 1803 - DNA, 19 bp, Homo sapiens
gatgtggtcacctacctgg

SEQ ID NO: 1804 - DNA, 19 bp, Homo sapiens
tggtgctggagaatgagct

SEQ ID NO: 1805 - DNA, 19 bp, Homo sapiens
gctggagtaaaactggaag

SEQ ID NO: 1806 - DNA, 19 bp, Homo sapiens
ttcaagatgactgcactgg

SEQ ID NO: 1807 - DNA, 19 bp, Homo sapiens
cctcacagagctatcactg

SEQ ID NO: 1808 - DNA, 19 bp, Homo sapiens
gcccactggtcgcctgcca

SEQ ID NO: 1809 - DNA, 19 bp, Homo sapiens
tttgagccaacattggaag

SEQ ID NO: 1810 - DNA, 19 bp, Homo sapiens
ctttgacaggcattttgaa

SEQ ID NO: 1811 - DNA, 19 bp, Homo sapiens
cttgaaattcaatcacaag

SEQ ID NO: 1812 - DNA, 19 bp, Homo sapiens
ttctgctgccttatcagca

SEQ ID NO: 1813 - DNA, 19 bp, Homo sapiens
ctggtcagtttgcaagcaa

SEQ ID NO: 1814 - DNA, 19 bp, Homo sapiens
cctggtcagtttgcaagca

SEQ ID NO: 1815 - DNA, 19 bp, Homo sapiens
ctcacatcctccagtggct

SEQ ID NO: 1816 - DNA, 19 bp, Homo sapiens
ggaactaccacaaaaagct

SEQ ID NO: 1817 - DNA, 19 bp, Homo sapiens
gaaatcttcaatttattct

SEQ ID NO: 1818 - DNA, 19 bp, Homo sapiens
aggacaccaaaataacctt

SEQ ID NO: 1819 - DNA, 19 bp, Homo sapiens
taagaactttgccacttct

SEQ ID NO: 1820 - DNA, 19 bp, Homo sapiens
ccctaacagatttgaggat

SEQ ID NO: 1821 - DNA, 19 bp, Homo sapiens
cccctaacagatttgagga

SEQ ID NO: 1822 - DNA, 19 bp, Homo sapiens
tgcctgcctttgaagtcag

SEQ ID NO: 1823 - DNA, 19 bp, Homo sapiens
tgataaaaaccaagatgtt

SEQ ID NO: 1824 - DNA, 19 bp, Homo sapiens
atgataaaaaccaagatgt

SEQ ID NO: 1825 - DNA, 19 bp, Homo sapiens
accaccagtttgtagatga

SEQ ID NO: 1826 - DNA, 19 bp, Homo sapiens
tcttccacatttcaaggaa

SEQ ID NO: 1827 - DNA, 19 bp, Homo sapiens
acaccttccacattccttc

SEQ ID NO: 1828 - DNA, 19 bp, Homo sapiens
acactaaatacttccacaa

SEQ ID NO: 1829 - DNA, 19 bp, Homo sapiens
gtggaggcaacacattaca

SEQ ID NO: 1830 - DNA, 19 bp, Homo sapiens
aaagaaacagcatttgttt

SEQ ID NO: 1831 - DNA, 19 bp, Homo sapiens
tcttacttttccattgagt

SEQ ID NO: 1832 - DNA, 19 bp, Homo sapiens
cctccagctcctgggaaag

SEQ ID NO: 1833 - DNA, 19 bp, Homo sapiens
ttcctaaagctggatgtaa

SEQ ID NO: 1834 - DNA, 19 bp, Homo sapiens
ccacaagtcatcatctcgt

SEQ ID NO: 1835 - DNA, 19 bp, Homo sapiens
gccagaagtgagatcctcg

SEQ ID NO: 1836 - DNA, 19 bp, Homo sapiens
tgccagtctccatgacctc

SEQ ID NO: 1837 - DNA, 19 bp, Homo sapiens
gttgctcttaaggacttcc

SEQ ID NO: 1838 - DNA, 19 bp, Homo sapiens
tgttgatgaggagtccttc

SEQ ID NO: 1839 - DNA, 19 bp, Homo sapiens
gcaagtctttcctggcctg

SEQ ID NO: 1840 - DNA, 19 bp, Homo sapiens
agcaagtctttcctggcct

SEQ ID NO: 1841 - DNA, 19 bp, Homo sapiens
atgaaagtcaagcatctga

SEQ ID NO: 1842 - DNA, 19 bp, Homo sapiens
gctgactttaaaatctgac

SEQ ID NO: 1843 - DNA, 19 bp, Homo sapiens
atgcactgtttctgagtcc

SEQ ID NO: 1844 - DNA, 19 bp, Homo sapiens
ggaatatcttagcatcctt

SEQ ID NO: 1845 - DNA, 19 bp, Homo sapiens
aggaatatcttagcatcct

SEQ ID NO: 1846 - DNA, 19 bp, Homo sapiens
aaggctgactctgtggttg

SEQ ID NO: 1847 - DNA, 19 bp, Homo sapiens
aaagcaggccgaagctgtt

SEQ ID NO: 1848 - DNA, 19 bp, Homo sapiens
atccatgatctacatttgt

SEQ ID NO: 1849 - DNA, 19 bp, Homo sapiens
catcactttacaagccttg

SEQ ID NO: 1850 - DNA, 19 bp, Homo sapiens
gtctcttcgttctatgcta

SEQ ID NO: 1851 - DNA, 19 bp, Homo sapiens
agtctcttcgttctatgct

SEQ ID NO: 1852 - DNA, 19 bp, Homo sapiens
aagtgtagtctcctggtgc

SEQ ID NO: 1853 - DNA, 19 bp, Homo sapiens
tttgaggattccatcagtt

SEQ ID NO: 1854 - DNA, 19 bp, Homo sapiens
gtacctacttttggcaagc

SEQ ID NO: 1855 - DNA, 19 bp, Homo sapiens
cttatgggatttcctaaag

SEQ ID NO: 1856 - DNA, 19 bp, Homo sapiens
gagggtagtcataacagta

SEQ ID NO: 1857 - DNA, 19 bp, Homo sapiens
tggaagtgtcagtggcaaa

SEQ ID NO: 1858 - DNA, 19 bp, Homo sapiens
gatggatatgaccttctct

SEQ ID NO: 1859 - DNA, 19 bp, Homo sapiens
gagaacatactgggcagct

SEQ ID NO: 1860 - DNA, 19 bp, Homo sapiens
gagaaaatcaatgccttca

SEQ ID NO: 1861 - DNA, 19 bp, Homo sapiens
agagccaggtcgagctttc

SEQ ID NO: 1862 - DNA, 19 bp, Homo sapiens
tctgatgaggaaactcaga

SEQ ID NO: 1863 - DNA, 19 bp, Homo sapiens
aacctcccattttttgaga

SEQ ID NO: 1864 - DNA, 19 bp, Homo sapiens
ctgatccccgagccctcag

SEQ ID NO: 1865 - DNA, 19 bp, Homo sapiens
gagaaaatcaatgccttca

SEQ ID NO: 1866 - DNA, 19 bp, Homo sapiens
aagaggcagcttctggctt

SEQ ID NO: 1867 - DNA, 19 bp, Homo sapiens
atcaaaagaagcccaagag

SEQ ID NO: 1868 - DNA, 19 bp, Homo sapiens
tcaaagttaattgggaaga

SEQ ID NO: 1869 - DNA, 19 bp, Homo sapiens
ctcaattttgattttcaag

SEQ ID NO: 1870 - DNA, 19 bp, Homo sapiens
gatggaaccctctccctca

SEQ ID NO: 1871 - DNA, 19 bp, Homo sapiens
ctgacatcttaggcactga

SEQ ID NO: 1872 - DNA, 19 bp, Homo sapiens
ttcagaagctaagcaatgt

SEQ ID NO: 1873 - DNA, 19 bp, Homo sapiens
tctctgaaagacaacgtgc

SEQ ID NO: 1874 - DNA, 19 bp, Homo sapiens
agataacattaaacagctg

SEQ ID NO: 1875 - DNA, 19 bp, Homo sapiens
ggctcaacacagacatcgc

SEQ ID NO: 1876 - DNA, 19 bp, Homo sapiens
tcccagaaaacctcttctt

SEQ ID NO: 1877 - DNA, 19 bp, Homo sapiens
caatggagagtccaacctg

SEQ ID NO: 1878 - DNA, 19 bp, Homo sapiens
gcaagggttcactgttcct

SEQ ID NO: 1879 - DNA, 19 bp, Homo sapiens
aattgggaagaagaggcag

SEQ ID NO: 1880 - DNA, 19 bp, Homo sapiens
gaatattttgagaggaatc

SEQ ID NO: 1881 - DNA, 19 bp, Homo sapiens
atgaagtagaccaacaaat

SEQ ID NO: 1882 - DNA, 19 bp, Homo sapiens
atttgtaagaaaatacaga

SEQ ID NO: 1883 - DNA, 19 bp, Homo sapiens
agtttctccatcctaggtt

SEQ ID NO: 1884 - DNA, 19 bp, Homo sapiens
ttctgaaaatccaatctcc

SEQ ID NO: 1885 - DNA, 19 bp, Homo sapiens
aagatcgcagactttgagt

SEQ ID NO: 1886 - DNA, 19 bp, Homo sapiens
tgaactcagaagaattgga

SEQ ID NO: 1887 - DNA, 19 bp, Homo sapiens
cagtcatgtagaaaaactt

SEQ ID NO: 1888 - DNA, 19 bp, Homo sapiens
ctggaactctctccatggc

SEQ ID NO: 1889 - DNA, 19 bp, Homo sapiens
tctgaactcagaaggatgg

SEQ ID NO: 1890 - DNA, 19 bp, Homo sapiens
ggatttcctaaagctggat

SEQ ID NO: 1891 - DNA, 19 bp, Homo sapiens
cctgaaatacaatgctctg

SEQ ID NO: 1892 - DNA, 19 bp, Homo sapiens
agaaacagcatttgtttgt

SEQ ID NO: 1893 - DNA, 19 bp, Homo sapiens
agaagctaagcaatgtcct

SEQ ID NO: 1894 - DNA, 19 bp, Homo sapiens
tgaaggctgactctgtggt

SEQ ID NO: 1895 - DNA, 19 bp, Homo sapiens
atcaggaagggctcaaaga

SEQ ID NO: 1896 - DNA, 19 bp, Homo sapiens
tcattactcctgggctgaa

SEQ ID NO: 1897 - DNA, 19 bp, Homo sapiens
tgaatctggctccctcaac

SEQ ID NO: 1898 - DNA, 19 bp, Homo sapiens
ttaatcgagaggtatgaag

SEQ ID NO: 1899 - DNA, 19 bp, Homo sapiens
gttaatcgagaggtatgaa

SEQ ID NO: 1900 - DNA, 19 bp, Homo sapiens
aattgcattagatgatgcc

SEQ ID NO: 1901 - DNA, 19 bp, Homo sapiens
tggagtttgtgacaaatat

SEQ ID NO: 1902 - DNA, 19 bp, Homo sapiens
agaaacagcatttgtttgt

SEQ ID NO: 1903 - DNA, 19 bp, Homo sapiens
caaatgacatgatgggctc

SEQ ID NO: 1904 - DNA, 19 bp, Homo sapiens
aagcatctgattgactcac

SEQ ID NO: 1905 - DNA, 19 bp, Homo sapiens
tgggcctgccccagattct

SEQ ID NO: 1906 - DNA, 19 bp, Homo sapiens
caataagatcaatagcaaa

SEQ ID NO: 1907 - DNA, 19 bp, Homo sapiens
ttggctcacatgaaggcca

SEQ ID NO: 1908 - DNA, 19 bp, Homo sapiens
gatatacactagggaggaa

SEQ ID NO: 1909 - DNA, 19 bp, Homo sapiens
agatcaaagttaattggga

SEQ ID NO: 1910 - DNA, 19 bp, Homo sapiens
gagtcccagtgcccagcaa

SEQ ID NO: 1911 - DNA, 19 bp, Homo sapiens
tcagtataagtacaaccaa

SEQ ID NO: 1912 - DNA, 19 bp, Homo sapiens
aacttccaactgtcatgga

SEQ ID NO: 1913 - DNA, 19 bp, Homo sapiens
ctttgaagtcagtcttcag

SEQ ID NO: 1914 - DNA, 19 bp, Homo sapiens
agaatctcaacttccaact

SEQ ID NO: 1915 - DNA, 19 bp, Homo sapiens
acaggggtcctttatgatt

SEQ ID NO: 1916 - DNA, 19 bp, Homo sapiens
atttgaaagaataaatgac

SEQ ID NO: 1917 - DNA, 19 bp, Homo sapiens
aacacattgaggctattga

SEQ ID NO: 1918 - DNA, 19 bp, Homo sapiens
gaaaaaggggattgaagtt

SEQ ID NO: 1919 - DNA, 19 bp, Homo sapiens
ataagcaaactgttaattt

SEQ ID NO: 1920 - DNA, 19 bp, Homo sapiens
aaatgcactgctgcgttct

SEQ ID NO: 1921 - DNA, 19 bp, Homo sapiens
caaaaacattttcaacttc

SEQ ID NO: 1922 - DNA, 19 bp, Homo sapiens
aaggaagaaagaaaaatca

SEQ ID NO: 1923 - DNA, 19 bp, Homo sapiens
gtcagcccagttccttcca

SEQ ID NO: 1924 - DNA, 19 bp, Homo sapiens
tgaggaaactcagatcaaa

SEQ ID NO: 1925 - DNA, 19 bp, Homo sapiens
aaagcattggtagagcaag

SEQ ID NO: 1926 - DNA, 19 bp, Homo sapiens
tcaagtctgtgggattcca

SEQ ID NO: 1927 - DNA, 19 bp, Homo sapiens
ccaagaggtatttaaagcc

SEQ ID NO: 1928 - DNA, 19 bp, Homo sapiens
agctttctgccactgctca

SEQ ID NO: 1929 - DNA, 19 bp, Homo sapiens
gagctttctgccactgctc

SEQ ID NO: 1930 - DNA, 19 bp, Homo sapiens
aaaagaaacagcatttgtt

SEQ ID NO: 1931 - DNA, 19 bp, Homo sapiens
ttccggcacgtgggttcca

SEQ ID NO: 1932 - DNA, 19 bp, Homo sapiens
ccttactgactttgcagag

SEQ ID NO: 1933 - DNA, 19 bp, Homo sapiens
aatcattgaaaaattaaaa

SEQ ID NO: 1934 - DNA, 19 bp, Homo sapiens
ttgatgaaatcattgaaaa

SEQ ID NO: 1935 - DNA, 19 bp, Homo sapiens
tcattgctcccggagccaa

SEQ ID NO: 1936 - DNA, 19 bp, Homo sapiens
tgttgcttttgtaaagtat

SEQ ID NO: 1937 - DNA, 19 bp, Homo sapiens
catttcagccttcgggctc

SEQ ID NO: 1938 - DNA, 19 bp, Homo sapiens
gcatgcctagtttctccat

SEQ ID NO: 1939 - DNA, 19 bp, Homo sapiens
agcacagtacgaaaaacca

SEQ ID NO: 1940 - DNA, 19 bp, Homo sapiens
ctgaaagagatgaaattta

SEQ ID NO: 1941 - DNA, 19 bp, Homo sapiens
aacagatttgaggattcca

SEQ ID NO: 1942 - DNA, 19 bp, Homo sapiens
atcacaactcctccactga

SEQ ID NO: 1943 - DNA, 19 bp, Homo sapiens
aatcacaactcctccactg

SEQ ID NO: 1944 - DNA, 19 bp, Homo sapiens
taatcacaactcctccact

SEQ ID NO: 1945 - DNA, 19 bp, Homo sapiens
ggatactaagtaccaaatc

SEQ ID NO: 1946 - DNA, 19 bp, Homo sapiens
cttccgtttaccagaaatc

SEQ ID NO: 1947 - DNA, 19 bp, Homo sapiens
acttccgtttaccagaaat

SEQ ID NO: 1948 - DNA, 19 bp, Homo sapiens
ttccaatttccctgtggat

SEQ ID NO: 1949 - DNA, 19 bp, Homo sapiens
cttccaatttccctgtgga

SEQ ID NO: 1950 - DNA, 19 bp, Homo sapiens
agattaatccgctggctct

SEQ ID NO: 1951 - DNA, 19 bp, Homo sapiens
aagattaatccgctggctc

SEQ ID NO: 1952 - DNA, 19 bp, Homo sapiens
accactgggacctaccaag

SEQ ID NO: 1953 - DNA, 19 bp, Homo sapiens
actggtggcaaaaccctcc

SEQ ID NO: 1954 - DNA, 19 bp, Homo sapiens
tggagaagccacactccaa

SEQ ID NO: 1955 - DNA, 19 bp, Homo sapiens
ctggtcgcctgccaaactg

SEQ ID NO: 1956 - DNA, 19 bp, Homo sapiens
ggagtcattgctcccggag

SEQ ID NO: 1957 - DNA, 19 bp, Homo sapiens
tcagaaagctaccttccag

SEQ ID NO: 1958 - DNA, 19 bp, Homo sapiens
agccagaagtgagatcctc

SEQ ID NO: 1959 - DNA, 19 bp, Homo sapiens
gaaggcatctgggagtctt

SEQ ID NO: 1960 - DNA, 19 bp, Homo sapiens
gatgcttacaacactaaag

SEQ ID NO: 1961 - DNA, 19 bp, Homo sapiens
ggcacttccaaaattgatg

SEQ ID NO: 1962 - DNA, 19 bp, Homo sapiens
aaagttaattgggaagaag

SEQ ID NO: 1963 - DNA, 19 bp, Homo sapiens
tgggctggcttcagccatt

SEQ ID NO: 1964 - DNA, 19 bp, Homo sapiens
cagtctgaacattgcaggc

SEQ ID NO: 1965 - DNA, 19 bp, Homo sapiens
cagtgcaacgaccaacttg

SEQ ID NO: 1966 - DNA, 19 bp, Homo sapiens
tactccaacgccagctcca

SEQ ID NO: 1967 - DNA, 19 bp, Homo sapiens
ctgccatctcgagagttcc

SEQ ID NO: 1968 - DNA, 19 bp, Homo sapiens
tgcctttgtgtacaccaaa

SEQ ID NO: 1969 - DNA, 19 bp, Homo sapiens
gatgggtctctacgccaca

SEQ ID NO: 1970 - DNA, 19 bp, Homo sapiens
cccaaggccacaggggtcc

SEQ ID NO: 1971 - DNA, 19 bp, Homo sapiens
gtgttctagacctctccac

SEQ ID NO: 1972 - DNA, 19 bp, Homo sapiens
ccagaatctgtaccaggaa

SEQ ID NO: 1973 - DNA, 19 bp, Homo sapiens
tgagaactacgagctgact

SEQ ID NO: 1974 - DNA, 19 bp, Homo sapiens
catgaaggccaaattccga

SEQ ID NO: 1975 - DNA, 19 bp, Homo sapiens
cttccagacacctgatttt

SEQ ID NO: 1976 - DNA, 19 bp, Homo sapiens
gaatttacaattgttgctt

SEQ ID NO: 1977 - DNA, 19 bp, Homo sapiens
gagcttcaggaagcttctc

SEQ ID NO: 1978 - DNA, 19 bp, Homo sapiens
accagtcagatattgttgc

SEQ ID NO: 1979 - DNA, 19 bp, Homo sapiens
tagaatatgaactaaatgt

SEQ ID NO: 1980 - DNA, 19 bp, Homo sapiens
gtagctgagaaaatcaatg

SEQ ID NO: 1981 - DNA, 19 bp, Homo sapiens
ggtggataccctgaagttt

SEQ ID NO: 1982 - DNA, 19 bp, Homo sapiens
aggaaaagcgcacctcaat

SEQ ID NO: 1983 - DNA, 19 bp, Homo sapiens
ccagcttccccacatctca

SEQ ID NO: 1984 - DNA, 19 bp, Homo sapiens
gtaagaaaatacagagcag

SEQ ID NO: 1985 - DNA, 19 bp, Homo sapiens
aggacagagccttggtgga

SEQ ID NO: 1986 - DNA, 19 bp, Homo sapiens
atctgatgaggaaactcag

SEQ ID NO: 1987 - DNA, 19 bp, Homo sapiens
ggcctctctggggcatcta

SEQ ID NO: 1988 - DNA, 19 bp, Homo sapiens
ctctcacaaaaaagtatag

SEQ ID NO: 1989 - DNA, 19 bp, Homo sapiens
cttcaggaagcttctcaag

SEQ ID NO: 1990 - DNA, 19 bp, Homo sapiens
ccttacacaataatcacaa

SEQ ID NO: 1991 - DNA, 19 bp, Homo sapiens
gcacctagctggaaagtta

SEQ ID NO: 1992 - DNA, 19 bp, Homo sapiens
tctgtgggattccatctgc

SEQ ID NO: 1993 - DNA, 19 bp, Homo sapiens
gtctgtgggattccatctg

SEQ ID NO: 1994 - DNA, 19 bp, Homo sapiens
tcaccaacggagaacatac

SEQ ID NO: 1995 - DNA, 19 bp, Homo sapiens
ttcaccaacggagaacata

SEQ ID NO: 1996 - DNA, 19 bp, Homo sapiens
aatctcaagctttctcttc

SEQ ID NO: 1997 - DNA, 19 bp, Homo sapiens
tgtacaactggtccgcctc

SEQ ID NO: 1998 - DNA, 19 bp, Homo sapiens
ctgttaggacaccagccct

SEQ ID NO: 1999 - DNA, 19 bp, Homo sapiens
tgaaattcaatcacaagtc

SEQ ID NO: 2000 - DNA, 19 bp, Homo sapiens
tcttttcttttcagcccag

SEQ ID NO: 2001 - DNA, 19 bp, Homo sapiens
caactgcagacatatatga

SEQ ID NO: 2002 - DNA, 19 bp, Homo sapiens
tcactccattaacctccca

SEQ ID NO: 2003 - DNA, 19 bp, Homo sapiens
cttcttttccaattgaact

SEQ ID NO: 2004 - DNA, 19 bp, Homo sapiens
tcttcatcttcatctgtca

SEQ ID NO: 2005 - DNA, 19 bp, Homo sapiens
ttcttcatcttcatctgtc

SEQ ID NO: 2006 - DNA, 19 bp, Homo sapiens
cttgtcatgcctacgttcc

SEQ ID NO: 2007 - DNA, 19 bp, Homo sapiens
aaaaagcgatggccgggtc

SEQ ID NO: 2008 - DNA, 19 bp, Homo sapiens
gtcaaatataccttgaaca

SEQ ID NO: 2009 - DNA, 19 bp, Homo sapiens
tgaacaagaacagtttgaa

SEQ ID NO: 2010 - DNA, 19 bp, Homo sapiens
agtttgaaaattgagattc

SEQ ID NO: 2011 - DNA, 19 bp, Homo sapiens
gtttgaaaattgagattcc

SEQ ID NO: 2012 - DNA, 19 bp, Homo sapiens
ttgaaaattgagattcctt

SEQ ID NO: 2013 - DNA, 19 bp, Homo sapiens
ctaaagatgttagagactg

SEQ ID NO: 2014 - DNA, 19 bp, Homo sapiens
atgttagagactgttagga

SEQ ID NO: 2015 - DNA, 19 bp, Homo sapiens
cagccctccacttcaagtc

SEQ ID NO: 2016 - DNA, 19 bp, Homo sapiens
agccctccacttcaagtct

SEQ ID NO: 2017 - DNA, 19 bp, Homo sapiens
ccatctgccatctcgagag

SEQ ID NO: 2018 - DNA, 19 bp, Homo sapiens
attcccaagttgtatcaac

SEQ ID NO: 2019 - DNA, 19 bp, Homo sapiens
tcaactgcaagtgcctctc

SEQ ID NO: 2020 - DNA, 19 bp, Homo sapiens
ggtgttctagacctctcca

SEQ ID NO: 2021 - DNA, 19 bp, Homo sapiens
ctccacgaatgtctacagc

SEQ ID NO: 2022 - DNA, 19 bp, Homo sapiens
cacgaatgtctacagcaac

SEQ ID NO: 2023 - DNA, 19 bp, Homo sapiens
acgaatgtctacagcaact

SEQ ID NO: 2024 - DNA, 19 bp, Homo sapiens
tcctacagtggtggcaaca

SEQ ID NO: 2025 - DNA, 19 bp, Homo sapiens
cgttaccacatgaaggctg

SEQ ID NO: 2026 - DNA, 19 bp, Homo sapiens
gaaggctgactctgtggtt

SEQ ID NO: 2027 - DNA, 19 bp, Homo sapiens
tgtggttgacctgctttcc

SEQ ID NO: 2028 - DNA, 19 bp, Homo sapiens
cctgctttcctacaatgtg

SEQ ID NO: 2029 - DNA, 19 bp, Homo sapiens
ctgctttcctacaatgtgc

SEQ ID NO: 2030 - DNA, 19 bp, Homo sapiens
tcctacaatgtgcaaggat

SEQ ID NO: 2031 - DNA, 19 bp, Homo sapiens
tatgaccacaagaatacgt

SEQ ID NO: 2032 - DNA, 19 bp, Homo sapiens
atgaccacaagaatacgtc

SEQ ID NO: 2033 - DNA, 19 bp, Homo sapiens
gaatacgtctacactatca

SEQ ID NO: 2034 - DNA, 19 bp, Homo sapiens
tttctagattcgaatatca

SEQ ID NO: 2035 - DNA, 19 bp, Homo sapiens
gattcgaatatcaaattca

SEQ ID NO: 2036 - DNA, 19 bp, Homo sapiens
gaaacaacccagtctcaaa

SEQ ID NO: 2037 - DNA, 19 bp, Homo sapiens
cccagtctcaaaaggttta

SEQ ID NO: 2038 - DNA, 19 bp, Homo sapiens
ctcaaaaggtttactaata

SEQ ID NO: 2039 - DNA, 19 bp, Homo sapiens
tcaaaaggtttactaatat

SEQ ID NO: 2040 - DNA, 19 bp, Homo sapiens
aaaaggtttactaatattc

SEQ ID NO: 2041 - DNA, 19 bp, Homo sapiens
gaaacagcatttgtttgtc

SEQ ID NO: 2042 - DNA, 19 bp, Homo sapiens
atttgtttgtcaaagaagt

SEQ ID NO: 2043 - DNA, 19 bp, Homo sapiens
tcaagattgatgggcagtt

SEQ ID NO: 2044 - DNA, 19 bp, Homo sapiens
ttcagagtctcttcgttct

SEQ ID NO: 2045 - DNA, 19 bp, Homo sapiens
cagagtctcttcgttctat

SEQ ID NO: 2046 - DNA, 19 bp, Homo sapiens
atgctaaaggcacatatgg

SEQ ID NO: 2047 - DNA, 19 bp, Homo sapiens
gcacatatggcctgtcttg

SEQ ID NO: 2048 - DNA, 19 bp, Homo sapiens
gagtccaacctgaggttta

SEQ ID NO: 2049 - DNA, 19 bp, Homo sapiens
agtccaacctgaggtttaa

SEQ ID NO: 2050 - DNA, 19 bp, Homo sapiens
cctacctccaaggcaccaa

SEQ ID NO: 2051 - DNA, 19 bp, Homo sapiens
gaagatggaaccctctccc

SEQ ID NO: 2052 - DNA, 19 bp, Homo sapiens
tgatctgcaaagtggcatc

SEQ ID NO: 2053 - DNA, 19 bp, Homo sapiens
gatctgcaaagtggcatca

SEQ ID NO: 2054 - DNA, 19 bp, Homo sapiens
gcttccctaaagtatgaga

SEQ ID NO: 2055 - DNA, 19 bp, Homo sapiens
gtatgagaactacgagctg

SEQ ID NO: 2056 - DNA, 19 bp, Homo sapiens
tctaacaagatggatatga

SEQ ID NO: 2057 - DNA, 19 bp, Homo sapiens
ctgctgcgttctgaatatc

SEQ ID NO: 2058 - DNA, 19 bp, Homo sapiens
tcattgaggttcttcagcc

SEQ ID NO: 2059 - DNA, 19 bp, Homo sapiens
ttctggatcactaaattcc

SEQ ID NO: 2060 - DNA, 19 bp, Homo sapiens
ccatggtcttgagttaaat

SEQ ID NO: 2061 - DNA, 19 bp, Homo sapiens
tcttaggcactgacaaaat

SEQ ID NO: 2062 - DNA, 19 bp, Homo sapiens
acaaggcgacactaaggat

SEQ ID NO: 2063 - DNA, 19 bp, Homo sapiens
tgcaacgaccaacttgaag

SEQ ID NO: 2064 - DNA, 19 bp, Homo sapiens
caacttgaagtgtagtctc

SEQ ID NO: 2065 - DNA, 19 bp, Homo sapiens
gctggagaatgagctgaat

SEQ ID NO: 2066 - DNA, 19 bp, Homo sapiens
gcagagcttggcctctctg

SEQ ID NO: 2067 - DNA, 19 bp, Homo sapiens
tctctggggcatctatgaa

SEQ ID NO: 2068 - DNA, 19 bp, Homo sapiens
tctggggcatctatgaaat

SEQ ID NO: 2069 - DNA, 19 bp, Homo sapiens
aacacaatgcaaaattcag

SEQ ID NO: 2070 - DNA, 19 bp, Homo sapiens
ctcacagagctatcactgg

SEQ ID NO: 2071 - DNA, 19 bp, Homo sapiens
tgggaagtgcttatcaggc

SEQ ID NO: 2072 - DNA, 19 bp, Homo sapiens
ttcaaggtcagtcaagaag

SEQ ID NO: 2073 - DNA, 19 bp, Homo sapiens
aatgacatgatgggctcat

SEQ ID NO: 2074 - DNA, 19 bp, Homo sapiens
gctcatatgctgaaatgaa

SEQ ID NO: 2075 - DNA, 19 bp, Homo sapiens
atatgctgaaatgaaattt

SEQ ID NO: 2076 - DNA, 19 bp, Homo sapiens
tctgaacattgcaggctta

SEQ ID NO: 2077 - DNA, 19 bp, Homo sapiens
gaacattgcaggcttatca

SEQ ID NO: 2078 - DNA, 19 bp, Homo sapiens
tgcaggcttatcactggac

SEQ ID NO: 2079 - DNA, 19 bp, Homo sapiens
tcaaaacttgacaacattt

SEQ ID NO: 2080 - DNA, 19 bp, Homo sapiens
atttacagctctgacaagt

SEQ ID NO: 2081 - DNA, 19 bp, Homo sapiens
ctctgacaagttttataag

SEQ ID NO: 2082 - DNA, 19 bp, Homo sapiens
gttaatttacagctacagc

SEQ ID NO: 2083 - DNA, 19 bp, Homo sapiens
ttctctggtaactacttta

SEQ ID NO: 2084 - DNA, 19 bp, Homo sapiens
cctaaaaggagcctaccaa

SEQ ID NO: 2085 - DNA, 19 bp, Homo sapiens
aaaaggagcctaccaaaat

SEQ ID NO: 2086 - DNA, 19 bp, Homo sapiens
aggagcctaccaaaataat

SEQ ID NO: 2087 - DNA, 19 bp, Homo sapiens
ataatgaaataaaacacat

SEQ ID NO: 2088 - DNA, 19 bp, Homo sapiens
aaaacacatctatgccatc

SEQ ID NO: 2089 - DNA, 19 bp, Homo sapiens
tgctaaggttcagggtgtg

SEQ ID NO: 2090 - DNA, 19 bp, Homo sapiens
gagtttagccatcggctca

SEQ ID NO: 2091 - DNA, 19 bp, Homo sapiens
gctggcttcagccattgac

SEQ ID NO: 2092 - DNA, 19 bp, Homo sapiens
atttcagcaatgtcttccg

SEQ ID NO: 2093 - DNA, 19 bp, Homo sapiens
tttcagcaatgtcttccgt

SEQ ID NO: 2094 - DNA, 19 bp, Homo sapiens
ttcagcaatgtcttccgtt

SEQ ID NO: 2095 - DNA, 19 bp, Homo sapiens
cagcaatgtcttccgttct

SEQ ID NO: 2096 - DNA, 19 bp, Homo sapiens
tgtcttccgttctgtaatg

SEQ ID NO: 2097 - DNA, 19 bp, Homo sapiens
gtcttccgttctgtaatgg

SEQ ID NO: 2098 - DNA, 19 bp, Homo sapiens
atgggaaactcgctctctg

SEQ ID NO: 2099 - DNA, 19 bp, Homo sapiens
ggagaacatactgggcagc

SEQ ID NO: 2100 - DNA, 19 bp, Homo sapiens
gttgaaagcagaacctctg

SEQ ID NO: 2101 - DNA, 19 bp, Homo sapiens
gtctaggaaaagcatcagt

SEQ ID NO: 2102 - DNA, 19 bp, Homo sapiens
agcatcagtgcagctcttg

SEQ ID NO: 2103 - DNA, 19 bp, Homo sapiens
ttgaacacaaagtcagtgc

SEQ ID NO: 2104 - DNA, 19 bp, Homo sapiens
gcagacaggcacctggaaa

SEQ ID NO: 2105 - DNA, 19 bp, Homo sapiens
gaaactcaagacccaattt

SEQ ID NO: 2106 - DNA, 19 bp, Homo sapiens
acaatgaatacagccagga

SEQ ID NO: 2107 - DNA, 19 bp, Homo sapiens
cttggatgcttacaacact

SEQ ID NO: 2108 - DNA, 19 bp, Homo sapiens
ttggcgtggagcttactgg

SEQ ID NO: 2109 - DNA, 19 bp, Homo sapiens
cacttttactcagtgagcc

SEQ ID NO: 2110 - DNA, 19 bp, Homo sapiens
tttagagatgagagatgcc

SEQ ID NO: 2111 - DNA, 19 bp, Homo sapiens
gagaagccccaagaattta

SEQ ID NO: 2112 - DNA, 19 bp, Homo sapiens
caattgttgcttttgtaaa

SEQ ID NO: 2113 - DNA, 19 bp, Homo sapiens
ttttgtaaagtatgataaa

SEQ ID NO: 2114 - DNA, 19 bp, Homo sapiens
ttgtaaagtatgataaaaa

SEQ ID NO: 2115 - DNA, 19 bp, Homo sapiens
ttcactccattaacctccc

SEQ ID NO: 2116 - DNA, 19 bp, Homo sapiens
ttttgagaccttgcaagaa

SEQ ID NO: 2117 - DNA, 19 bp, Homo sapiens
accttgcaagaatattttg

SEQ ID NO: 2118 - DNA, 19 bp, Homo sapiens
tcaatattgatcaatttgt

SEQ ID NO: 2119 - DNA, 19 bp, Homo sapiens
cagagcagccctgggaaaa

SEQ ID NO: 2120 - DNA, 19 bp, Homo sapiens
cctgggaaaactcccacag

SEQ ID NO: 2121 - DNA, 19 bp, Homo sapiens
actcccacagcaagctaat

SEQ ID NO: 2122 - DNA, 19 bp, Homo sapiens
aattcattcaattgggaga

SEQ ID NO: 2123 - DNA, 19 bp, Homo sapiens
ttcaattgggagagacaag

SEQ ID NO: 2124 - DNA, 19 bp, Homo sapiens
aggagaaactgactgctct

SEQ ID NO: 2125 - DNA, 19 bp, Homo sapiens
actgactgctctcacaaaa

SEQ ID NO: 2126 - DNA, 19 bp, Homo sapiens
gactgctctcacaaaaaag

SEQ ID NO: 2127 - DNA, 19 bp, Homo sapiens
cagacatatatgatacaat

SEQ ID NO: 2128 - DNA, 19 bp, Homo sapiens
aatttgatcagtatattaa

SEQ ID NO: 2129 - DNA, 19 bp, Homo sapiens
tatgatttacatgatttga

SEQ ID NO: 2130 - DNA, 19 bp, Homo sapiens
tttgaaaatagctattgct

SEQ ID NO: 2131 - DNA, 19 bp, Homo sapiens
ttgaaaatagctattgcta

SEQ ID NO: 2132 - DNA, 19 bp, Homo sapiens
aatagctattgctaatatt

SEQ ID NO: 2133 - DNA, 19 bp, Homo sapiens
attattgatgaaatcattg

SEQ ID NO: 2134 - DNA, 19 bp, Homo sapiens
aaagtcttgatgagcacta

SEQ ID NO: 2135 - DNA, 19 bp, Homo sapiens
aagtcttgatgagcactat

SEQ ID NO: 2136 - DNA, 19 bp, Homo sapiens
ttgatgagcactatcatat

SEQ ID NO: 2137 - DNA, 19 bp, Homo sapiens
taattttagtaaaaacaat

SEQ ID NO: 2138 - DNA, 19 bp, Homo sapiens
ttttagtaaaaacaatcca

SEQ ID NO: 2139 - DNA, 19 bp, Homo sapiens
acatttgtttattgaaaat

SEQ ID NO: 2140 - DNA, 19 bp, Homo sapiens
attgattttaacaaaagtg

SEQ ID NO: 2141 - DNA, 19 bp, Homo sapiens
attttaacaaaagtggaag

SEQ ID NO: 2142 - DNA, 19 bp, Homo sapiens
aaatcagaatccagataca

SEQ ID NO: 2143 - DNA, 19 bp, Homo sapiens
gaatccagatacaagaaaa

SEQ ID NO: 2144 - DNA, 19 bp, Homo sapiens
ttaagagacacatacagaa

SEQ ID NO: 2145 - DNA, 19 bp, Homo sapiens
atccagcacctagctggaa

SEQ ID NO: 2146 - DNA, 19 bp, Homo sapiens
tgagcatgtcaaacacttt

SEQ ID NO: 2147 - DNA, 19 bp, Homo sapiens
gagcatgtcaaacactttg

SEQ ID NO: 2148 - DNA, 19 bp, Homo sapiens
aaacactttgttataaatc

SEQ ID NO: 2149 - DNA, 19 bp, Homo sapiens
tgagaaaatcaatgccttc

SEQ ID NO: 2150 - DNA, 19 bp, Homo sapiens
tatgaagtagaccaacaaa

SEQ ID NO: 2151 - DNA, 19 bp, Homo sapiens
aagtagaccaacaaatcca

SEQ ID NO: 2152 - DNA, 19 bp, Homo sapiens
aagttgaaggagactattc

SEQ ID NO: 2153 - DNA, 19 bp, Homo sapiens
acaagttaagataaaagat

SEQ ID NO: 2154 - DNA, 19 bp, Homo sapiens
aagataaaagattactttg

SEQ ID NO: 2155 - DNA, 19 bp, Homo sapiens
gattactttgagaaattag

SEQ ID NO: 2156 - DNA, 19 bp, Homo sapiens
tgagaaattagttggattt

SEQ ID NO: 2157 - DNA, 19 bp, Homo sapiens
aaattagttggatttattg

SEQ ID NO: 2158 - DNA, 19 bp, Homo sapiens
tggatttattgatgatgct

SEQ ID NO: 2159 - DNA, 19 bp, Homo sapiens
tcattgaagatgttaacaa

SEQ ID NO: 2160 - DNA, 19 bp, Homo sapiens
cattgaagatgttaacaaa

SEQ ID NO: 2161 - DNA, 19 bp, Homo sapiens
attgaagatgttaacaaat

SEQ ID NO: 2162 - DNA, 19 bp, Homo sapiens
ttgaagatgttaacaaatt

SEQ ID NO: 2163 - DNA, 19 bp, Homo sapiens
tgaagatgttaacaaattc

SEQ ID NO: 2164 - DNA, 19 bp, Homo sapiens
acatgttgataaagaaatt

SEQ ID NO: 2165 - DNA, 19 bp, Homo sapiens
tttgattaccaccagtttg

SEQ ID NO: 2166 - DNA, 19 bp, Homo sapiens
caaaatccgtgaggtgact

SEQ ID NO: 2167 - DNA, 19 bp, Homo sapiens
aaaatccgtgaggtgactc

SEQ ID NO: 2168 - DNA, 19 bp, Homo sapiens
aggtgactcagagactcaa

SEQ ID NO: 2169 - DNA, 19 bp, Homo sapiens
gtgaaattcaggctctgga

SEQ ID NO: 2170 - DNA, 19 bp, Homo sapiens
gttgcagtgtatctggaaa

SEQ ID NO: 2171 - DNA, 19 bp, Homo sapiens
ttaagttcagcatctttgg

SEQ ID NO: 2172 - DNA, 19 bp, Homo sapiens
tgaaggccaaattccgaga

SEQ ID NO: 2173 - DNA, 19 bp, Homo sapiens
aatgtatcaaatggacatt

SEQ ID NO: 2174 - DNA, 19 bp, Homo sapiens
attcagcaggaacttcaac

SEQ ID NO: 2175 - DNA, 19 bp, Homo sapiens
acctgtctctggtcagcca

SEQ ID NO: 2176 - DNA, 19 bp, Homo sapiens
cctgtctctggtcagccag

SEQ ID NO: 2177 - DNA, 19 bp, Homo sapiens
ggtcagccaggtttatagc

SEQ ID NO: 2178 - DNA, 19 bp, Homo sapiens
ccaggtttatagcacactt

SEQ ID NO: 2179 - DNA, 19 bp, Homo sapiens
gtttatagcacacttgtca

SEQ ID NO: 2180 - DNA, 19 bp, Homo sapiens
acttgtcacctacatttct

SEQ ID NO: 2181 - DNA, 19 bp, Homo sapiens
ctgattggtggactcttgc

SEQ ID NO: 2182 - DNA, 19 bp, Homo sapiens
atgaaagcattggtagagc

SEQ ID NO: 2183 - DNA, 19 bp, Homo sapiens
tgaaagcattggtagagca

SEQ ID NO: 2184 - DNA, 19 bp, Homo sapiens
gggttcactgttcctgaaa

SEQ ID NO: 2185 - DNA, 19 bp, Homo sapiens
tcaagaccatccttgggac

SEQ ID NO: 2186 - DNA, 19 bp, Homo sapiens
ccttgggaccatgcctgcc

SEQ ID NO: 2187 - DNA, 19 bp, Homo sapiens
ttcaggctcttcagaaagc

SEQ ID NO: 2188 - DNA, 19 bp, Homo sapiens
ttcagataaacttcaaaga

SEQ ID NO: 2189 - DNA, 19 bp, Homo sapiens
acttcaaagacttaaaaaa

SEQ ID NO: 2190 - DNA, 19 bp, Homo sapiens
atcccatccaggttttcca

SEQ ID NO: 2191 - DNA, 19 bp, Homo sapiens
gaatttaccatccttaaca

SEQ ID NO: 2192 - DNA, 19 bp, Homo sapiens
cattccttcctttacaatt

SEQ ID NO: 2193 - DNA, 19 bp, Homo sapiens
ttgaccagatgctgaacag

SEQ ID NO: 2194 - DNA, 19 bp, Homo sapiens
aatcaccctgccagacttc

SEQ ID NO: 2195 - DNA, 19 bp, Homo sapiens
tgaccttcacataccagaa

SEQ ID NO: 2196 - DNA, 19 bp, Homo sapiens
ttccagcttccccacatct

SEQ ID NO: 2197 - DNA, 19 bp, Homo sapiens
aagctatacagtattctga

SEQ ID NO: 2198 - DNA, 19 bp, Homo sapiens
attctgaaaatccaatctc

SEQ ID NO: 2199 - DNA, 19 bp, Homo sapiens
tttcacattagatgcaaat

SEQ ID NO: 2200 - DNA, 19 bp, Homo sapiens
caaatgctgacatagggaa

SEQ ID NO: 2201 - DNA, 19 bp, Homo sapiens
gagagtccaaattagaagt

SEQ ID NO: 2202 - DNA, 19 bp, Homo sapiens
agagtccaaattagaagtt

SEQ ID NO: 2203 - DNA, 19 bp, Homo sapiens
tctcaattttgattttcaa

SEQ ID NO: 2204 - DNA, 19 bp, Homo sapiens
caattttgattttcaagca

SEQ ID NO: 2205 - DNA, 19 bp, Homo sapiens
aatgcacaactctcaaacc

SEQ ID NO: 2206 - DNA, 19 bp, Homo sapiens
agttctccagcaagtacct

SEQ ID NO: 2207 - DNA, 19 bp, Homo sapiens
agtacctgagaacggagca

SEQ ID NO: 2208 - DNA, 19 bp, Homo sapiens
tcaaacacagtggcaagtt

SEQ ID NO: 2209 - DNA, 19 bp, Homo sapiens
acaatcagcttaccctgga

SEQ ID NO: 2210 - DNA, 19 bp, Homo sapiens
ctggatagcaacactaaat

SEQ ID NO: 2211 - DNA, 19 bp, Homo sapiens
ctgacctgcgcaacgagat

SEQ ID NO: 2212 - DNA, 19 bp, Homo sapiens
agatgagggaacacatgaa

SEQ ID NO: 2213 - DNA, 19 bp, Homo sapiens
tcaacttttctaaacttga

SEQ ID NO: 2214 - DNA, 19 bp, Homo sapiens
ttctaaacttgaaattcaa

SEQ ID NO: 2215 - DNA, 19 bp, Homo sapiens
gaaattcaatcacaagtcg

SEQ ID NO: 2216 - DNA, 19 bp, Homo sapiens
cactgtttggagaagggaa

SEQ ID NO: 2217 - DNA, 19 bp, Homo sapiens
actgtttggagaagggaag

SEQ ID NO: 2218 - DNA, 19 bp, Homo sapiens
aattctcttttcttttcag

SEQ ID NO: 2219 - DNA, 19 bp, Homo sapiens
ttcttttcagcccagccat

SEQ ID NO: 2220 - DNA, 19 bp, Homo sapiens
tttgaaagttcgttttcca

SEQ ID NO: 2221 - DNA, 19 bp, Homo sapiens
cagggaagatagacttcct

SEQ ID NO: 2222 - DNA, 19 bp, Homo sapiens
ataagtacaaccaaaattt

SEQ ID NO: 2223 - DNA, 19 bp, Homo sapiens
acaacgagaacattatgga

SEQ ID NO: 2224 - DNA, 19 bp, Homo sapiens
aggaataaatggagaagca

SEQ ID NO: 2225 - DNA, 19 bp, Homo sapiens
agcaaatctggatttctta

SEQ ID NO: 2226 - DNA, 19 bp, Homo sapiens
tcctttaacaattcctgaa

SEQ ID NO: 2227 - DNA, 19 bp, Homo sapiens
tttaacaattcctgaaatg

SEQ ID NO: 2228 - DNA, 19 bp, Homo sapiens
acacaataatcacaactcc

SEQ ID NO: 2229 - DNA, 19 bp, Homo sapiens
aagatttctctctatggga

SEQ ID NO: 2230 - DNA, 19 bp, Homo sapiens
gaaaaaacaggcttgaagg

SEQ ID NO: 2231 - DNA, 19 bp, Homo sapiens
ttgaaggaattcttgaaaa

SEQ ID NO: 2232 - DNA, 19 bp, Homo sapiens
tgaaggaattcttgaaaac

SEQ ID NO: 2233 - DNA, 19 bp, Homo sapiens
agctcagtataagaaaaac

SEQ ID NO: 2234 - DNA, 19 bp, Homo sapiens
tcaaatcctttgacaggca

SEQ ID NO: 2235 - DNA, 19 bp, Homo sapiens
atgaaacaaaaattaagtt

SEQ ID NO: 2236 - DNA, 19 bp, Homo sapiens
aattcctggatacactgtt

SEQ ID NO: 2237 - DNA, 19 bp, Homo sapiens
ttccagttgtcaatgttga

SEQ ID NO: 2238 - DNA, 19 bp, Homo sapiens
aagtgtctccattcaccat

SEQ ID NO: 2239 - DNA, 19 bp, Homo sapiens
gtcagcatgcctagtttct

SEQ ID NO: 2240 - DNA, 19 bp, Homo sapiens
ctgccatgggcaatattac

SEQ ID NO: 2241 - DNA, 19 bp, Homo sapiens
tgaataccaatgctgaact

SEQ ID NO: 2242 - DNA, 19 bp, Homo sapiens
tattgttgctcatctcctt

SEQ ID NO: 2243 - DNA, 19 bp, Homo sapiens
tgttgctcatctcctttct

SEQ ID NO: 2244 - DNA, 19 bp, Homo sapiens
tctgtcattgatgcactgc

SEQ ID NO: 2245 - DNA, 19 bp, Homo sapiens
ccacagctctgtctctgag

SEQ ID NO: 2246 - DNA, 19 bp, Homo sapiens
atttgtggagggtagtcat

SEQ ID NO: 2247 - DNA, 19 bp, Homo sapiens
atatggaagtgtcagtggc

SEQ ID NO: 2248 - DNA, 19 bp, Homo sapiens
tggaaataccaagtcaaaa

SEQ ID NO: 2249 - DNA, 19 bp, Homo sapiens
aagtcaaaacctactgtct

SEQ ID NO: 2250 - DNA, 19 bp, Homo sapiens
actgtctcttcctccatgg

SEQ ID NO: 2251 - DNA, 19 bp, Homo sapiens
cttcctccatggaatttaa

SEQ ID NO: 2252 - DNA, 19 bp, Homo sapiens
attcttcaatgctgtactc

SEQ ID NO: 2253 - DNA, 19 bp, Homo sapiens
ttgaccacaagcttagctt

SEQ ID NO: 2254 - DNA, 19 bp, Homo sapiens
cctcacctcttacttttcc

SEQ ID NO: 2255 - DNA, 19 bp, Homo sapiens
agctgcagggcacttccaa

SEQ ID NO: 2256 - DNA, 19 bp, Homo sapiens
ttccaaaattgatgatatc

SEQ ID NO: 2257 - DNA, 19 bp, Homo sapiens
gagaacatacaagcaaagc

SEQ ID NO: 2258 - DNA, 19 bp, Homo sapiens
atggcaaatgtcagctctt

SEQ ID NO: 2259 - DNA, 19 bp, Homo sapiens
tggcaaatgtcagctcttg

SEQ ID NO: 2260 - DNA, 19 bp, Homo sapiens
ttgttcaggtccatgcaag

SEQ ID NO: 2261 - DNA, 19 bp, Homo sapiens
tgttcaggtccatgcaagt

SEQ ID NO: 2262 - DNA, 19 bp, Homo sapiens
agttccttccatgatttcc

SEQ ID NO: 2263 - DNA, 19 bp, Homo sapiens
tgctaacactaagaaccag

SEQ ID NO: 2264 - DNA, 19 bp, Homo sapiens
actaagaaccagaagatca

SEQ ID NO: 2265 - DNA, 19 bp, Homo sapiens
ctaagaaccagaagatcag

SEQ ID NO: 2266 - DNA, 19 bp, Homo sapiens
cagaagatcagatggaaaa

SEQ ID NO: 2267 - DNA, 19 bp, Homo sapiens
aaaaatgaagtccggattc

SEQ ID NO: 2268 - DNA, 19 bp, Homo sapiens
gattcattctgggtctttc

SEQ ID NO: 2269 - DNA, 19 bp, Homo sapiens
aagaaaaggcacaccttga

SEQ ID NO: 2270 - DNA, 19 bp, Homo sapiens
aaggacacctaaggttcct

SEQ ID NO: 2271 - DNA, 19 bp, Homo sapiens
ccagcattggtaggagaca

SEQ ID NO: 2272 - DNA, 19 bp, Homo sapiens
ctttgtgtacaccaaaaac

SEQ ID NO: 2273 - DNA, 19 bp, Homo sapiens
ccatccctgtaaaagtttt

SEQ ID NO: 2274 - DNA, 19 bp, Homo sapiens
tgatctaaattcagttctt

SEQ ID NO: 2275 - DNA, 19 bp, Homo sapiens
aagaagctgagaacttcat

SEQ ID NO: 2276 - DNA, 19 bp, Homo sapiens
tttgccctcaacctaccaa

SEQ ID NO: 2277 - DNA, 19 bp, Homo sapiens
cttgattcccttttttgag

SEQ ID NO: 2278 - DNA, 19 bp, Homo sapiens
ttcacgcttccaaaaagtg

SEQ ID NO: 2279 - DNA, 19 bp, Homo sapiens
tgtttcagatggcattgct

SEQ ID NO: 2280 - DNA, 19 bp, Homo sapiens
aatgcagtagccaacaaga

SEQ ID NO: 2281 - DNA, 19 bp, Homo sapiens
ctgagcagaccattgagat

SEQ ID NO: 2282 - DNA, 19 bp, Homo sapiens
tgagcagaccattgagatt

SEQ ID NO: 2283 - DNA, 19 bp, Homo sapiens
ttgagattccctccattaa

SEQ ID NO: 2284 - DNA, 19 bp, Homo sapiens
acttggagtgccagtttga

SEQ ID NO: 2285 - DNA, 19 bp, Homo sapiens
caaatttgaaggacttcag

SEQ ID NO: 2286 - DNA, 19 bp, Homo sapiens
agcccagcgttcaccgatc

SEQ ID NO: 2287 - DNA, 19 bp, Homo sapiens
cagcgttcaccgatctcca

SEQ ID NO: 2288 - DNA, 19 bp, Homo sapiens
ctccatctgcgctaccaga

SEQ ID NO: 2289 - DNA, 19 bp, Homo sapiens
atgaggaaactcagatcaa

SEQ ID NO: 2290 - DNA, 19 bp, Homo sapiens
aggcagcttctggcttgct

SEQ ID NO: 2291 - DNA, 19 bp, Homo sapiens
tgaaagacaacgtgcccaa

SEQ ID NO: 2292 - DNA, 19 bp, Homo sapiens
tatgattatgtcaacaagt

SEQ ID NO: 2293 - DNA, 19 bp, Homo sapiens
cattaggcaaattgatgat

SEQ ID NO: 2294 - DNA, 19 bp, Homo sapiens
ttgactcaggaaggccaag

SEQ ID NO: 2295 - DNA, 19 bp, Homo sapiens
gaaacctgggatatacact

SEQ ID NO: 2296 - DNA, 19 bp, Homo sapiens
tcctttcgagttaaggaaa

SEQ ID NO: 2297 - DNA, 19 bp, Homo sapiens
gccattcagtctctcaaga

SEQ ID NO: 2298 - DNA, 19 bp, Homo sapiens
gtgctacgtaatcttcagg

SEQ ID NO: 2299 - DNA, 19 bp, Homo sapiens
agctgaaagagatgaaatt

SEQ ID NO: 2300 - DNA, 19 bp, Homo sapiens
aatttacttatcttattaa

SEQ ID NO: 2301 - DNA, 19 bp, Homo sapiens
ttttaaattgttgaaagaa

SEQ ID NO: 2302 - DNA, 19 bp, Homo sapiens
taatcttcataagttcaat

SEQ ID NO: 2303 - DNA, 19 bp, Homo sapiens
atattttgatccaagtata

SEQ ID NO: 2304 - DNA, 19 bp, Homo sapiens
tgaaatattatgaacttga

SEQ ID NO: 2305 - DNA, 19 bp, Homo sapiens
caatttctgcacagaaata

SEQ ID NO: 2306 - DNA, 19 bp, Homo sapiens
agaagattgcagagctttc

SEQ ID NO: 2307 - DNA, 19 bp, Homo sapiens
gaagaaaataatttctgat

SEQ ID NO: 2308 - DNA, 19 bp, Homo sapiens
ttgacctgtccattcaaaa

SEQ ID NO: 2309 - DNA, 19 bp, Homo sapiens
tcaaaactaccacacattt

SEQ ID NO: 2310 - DNA, 19 bp, Homo sapiens
ttttttaaaagaaatcttc

SEQ ID NO: 2311 - DNA, 19 bp, Homo sapiens
aggatctgagttattttgc

SEQ ID NO: 2312 - DNA, 19 bp, Homo sapiens
tttgctaaacttgggggag

SEQ ID NO: 2313 - DNA, 19 bp, Homo sapiens
gaccttgcaagaatatttt

SEQ ID NO: 2314 - DNA, 19 bp, Homo sapiens
tgttaacaaattccttgac

SEQ ID NO: 2315 - DNA, 19 bp, Homo sapiens
ttcaagttcctgaccttca

SEQ ID NO: 2316 - DNA, 19 bp, Homo sapiens
gaatctggctccctcaact

SEQ ID NO: 2317 - DNA, 19 bp, Homo sapiens
ggaaataccaagtcaaaac

SEQ ID NO: 2318 - DNA, 19 bp, Homo sapiens
aaggaaaagcgcacctcaa

SEQ ID NO: 2319 - DNA, 19 bp, Homo sapiens
cagttgaccacaagcttag

SEQ ID NO: 2320 - DNA, 19 bp, Homo sapiens
tccttaacaccttccacat

SEQ ID NO: 2321 - DNA, 19 bp, Homo sapiens
gacttctctagtcaggctg

SEQ ID NO: 2322 - DNA, 19 bp, Homo sapiens
agacatcgctgggctggct

SEQ ID NO: 2323 - DNA, 19 bp, Homo sapiens
ctctcaaatgacatgatgg

SEQ ID NO: 2324 - DNA, 19 bp, Homo sapiens
gttgagaagccccaagaat

SEQ ID NO: 2325 - DNA, 19 bp, Homo sapiens
gagatcaagacactgttga

SEQ ID NO: 2326 - DNA, 19 bp, Homo sapiens
tggaaccctctccctcacc

SEQ ID NO: 2327 - DNA, 19 bp, Homo sapiens
gctggtaacctaaaaggag

SEQ ID NO: 2328 - DNA, 19 bp, Homo sapiens
gttgcccaccatcatcgtg

SEQ ID NO: 2329 - DNA, 19 bp, Homo sapiens
agttgcccaccatcatcgt

SEQ ID NO: 2330 - DNA, 19 bp, Homo sapiens
tgttagttgctcttaagga

SEQ ID NO: 2331 - DNA, 19 bp, Homo sapiens
cagcaagtacctgagaacg

SEQ ID NO: 2332 - DNA, 19 bp, Homo sapiens
aacctatgccttaatcttc

SEQ ID NO: 2333 - DNA, 19 bp, Homo sapiens
ggaaagttaaaacaacaca

SEQ ID NO: 2334 - DNA, 19 bp, Homo sapiens
cacaccttgacattgcagg

SEQ ID NO: 2335 - DNA, 19 bp, Homo sapiens
gcacaccttgacattgcag

SEQ ID NO: 2336 - DNA, 19 bp, Homo sapiens
atccgctggctctgaagga

SEQ ID NO: 2337 - DNA, 19 bp, Homo sapiens
acgtccgtgtgccttcata

SEQ ID NO: 2338 - DNA, 19 bp, Homo sapiens
gacgtccgtgtgccttcat

SEQ ID NO: 2339 - DNA, 19 bp, Homo sapiens
tgattatctgaattcattc

SEQ ID NO: 2340 - DNA, 19 bp, Homo sapiens
tgatttacatgatttgaaa

SEQ ID NO: 2341 - DNA, 19 bp, Homo sapiens
tgaagtagctgagaaaatc

SEQ ID NO: 2342 - DNA, 19 bp, Homo sapiens
tttgaaaaattctcttttc

SEQ ID NO: 2343 - DNA, 19 bp, Homo sapiens
taaattcattactcctggg

SEQ ID NO: 2344 - DNA, 19 bp, Homo sapiens
tattcaaaactgagttgag

SEQ ID NO: 2345 - DNA, 19 bp, Homo sapiens
atattcaaaactgagttga

SEQ ID NO: 2346 - DNA, 19 bp, Homo sapiens
gaatttgaaagttcgtttt

SEQ ID NO: 2347 - DNA, 19 bp, Homo sapiens
gacagcatcttcgtgtttc

SEQ ID NO: 2348 - DNA, 19 bp, Homo sapiens
acttaaaaaatataaaaat

SEQ ID NO: 2349 - DNA, 19 bp, Homo sapiens
aactctcaagtcaagttga

SEQ ID NO: 2350 - DNA, 19 bp, Homo sapiens
agaagatggcaaatttgaa

SEQ ID NO: 2351 - DNA, 19 bp, Homo sapiens
atagcatggacttcttctg

SEQ ID NO: 2352 - DNA, 19 bp, Homo sapiens
ccatttgagatcacggcat

SEQ ID NO: 2353 - DNA, 19 bp, Homo sapiens
caagttggcaagtaagtgc

SEQ ID NO: 2354 - DNA, 19 bp, Homo sapiens
taaagtgccacttttactc

SEQ ID NO: 2355 - DNA, 19 bp, Homo sapiens
ttaacagggaagatagact

SEQ ID NO: 2356 - DNA, 19 bp, Homo sapiens
ttggcaagtaagtgctagg

SEQ ID NO: 2357 - DNA, 19 bp, Homo sapiens
gggaagaagaggcagcttc

SEQ ID NO: 2358 - DNA, 19 bp, Homo sapiens
gatgaggaaactcagatca

SEQ ID NO: 2359 - DNA, 19 bp, Homo sapiens
tgatgaggaaactcagatc

SEQ ID NO: 2360 - DNA, 19 bp, Homo sapiens
tctcgtgtctaggaaaagc

SEQ ID NO: 2361 - DNA, 19 bp, Homo sapiens
cagcttaagagacacatac

SEQ ID NO: 2362 - DNA, 19 bp, Homo sapiens
tcattttccaactaataga

SEQ ID NO: 2363 - DNA, 19 bp, Homo sapiens
gatacaagaaaaactgcag

SEQ ID NO: 2364 - DNA, 19 bp, Homo sapiens
ggctcatatgctgaaatga

SEQ ID NO: 2365 - DNA, 19 bp, Homo sapiens
ggaaggacaaggcccagaa

SEQ ID NO: 2366 - DNA, 19 bp, Homo sapiens
atttttattcctgccatgg

SEQ ID NO: 2367 - DNA, 19 bp, Homo sapiens
attttttgcaagttaaaga

SEQ ID NO: 2368 - DNA, 19 bp, Homo sapiens
atccatgatctacatttgt

SEQ ID NO: 2369 - DNA, 19 bp, Homo sapiens
cttcagggaacacaatgca

SEQ ID NO: 2370 - DNA, 19 bp, Homo sapiens
gagatgagagatgccgttg

SEQ ID NO: 2371 - DNA, 19 bp, Homo sapiens
attctcttttcttttcagc

SEQ ID NO: 2372 - DNA, 19 bp, Homo sapiens
cagatacaagaaaaactgc

SEQ ID NO: 2373 - DNA, 19 bp, Homo sapiens
ttcattcaattgggagaga

SEQ ID NO: 2374 - DNA, 19 bp, Homo sapiens
atttgtaagaaaatacaga

SEQ ID NO: 2375 - DNA, 19 bp, Homo sapiens
ctgaagcattaaaactgtt

SEQ ID NO: 2376 - DNA, 19 bp, Homo sapiens
ccagatgctgaacagtgag

SEQ ID NO: 2377 - DNA, 19 bp, Homo sapiens
gcctacgttccatgtccca

SEQ ID NO: 2378 - DNA, 19 bp, Homo sapiens
cttcagtgcagaatatgaa

SEQ ID NO: 2379 - DNA, 19 bp, Homo sapiens
atgattatctgaattcatt

SEQ ID NO: 2380 - DNA, 19 bp, Homo sapiens
ttcagccattgacatgagc

SEQ ID NO: 2381 - DNA, 19 bp, Homo sapiens
aaatagctattgctaatat

SEQ ID NO: 2382 - DNA, 19 bp, Homo sapiens
taagaaccagaagatcaga

SEQ ID NO: 2383 - DNA, 19 bp, Homo sapiens
tgatatcgacgtgaggttc

SEQ ID NO: 2384 - DNA, 19 bp, Homo sapiens
gtcctggattccacatgca

SEQ ID NO: 2385 - DNA, 19 bp, Homo sapiens
aaattccttgacatgttga

SEQ ID NO: 2386 - DNA, 19 bp, Homo sapiens
acttaaaaaatataaaaat

SEQ ID NO: 2387 - DNA, 19 bp, Homo sapiens
cttacttgaattccaagag

SEQ ID NO: 2388 - DNA, 19 bp, Homo sapiens
gctgcatgtggctggtaac

SEQ ID NO: 2389 - DNA, 19 bp, Homo sapiens
taaaagattactttgagaa

SEQ ID NO: 2390 - DNA, 19 bp, Homo sapiens
ttggcaagtaagtgctagg

SEQ ID NO: 2391 - DNA, 19 bp, Homo sapiens
atttacaattgttgctttt

SEQ ID NO: 2392 - DNA, 19 bp, Homo sapiens
attacctatgatttctcct

SEQ ID NO: 2393 - DNA, 19 bp, Homo sapiens
atgtcaaacactttgttat

SEQ ID NO: 2394 - DNA, 19 bp, Homo sapiens
gatgaagatgacgactttt

SEQ ID NO: 2395 - DNA, 19 bp, Homo sapiens
cacaagtcgattcccagca

SEQ ID NO: 2396 - DNA, 19 bp, Homo sapiens
tgaggtgactcagagactc

SEQ ID NO: 2397 - DNA, 19 bp, Homo sapiens
gtcagtgaagttctccagc

SEQ ID NO: 2398 - DNA, 19 bp, Homo sapiens
cggagcatgggagtgaaat

SEQ ID NO: 2399 - DNA, 19 bp, Homo sapiens
acggagcatgggagtgaaa

SEQ ID NO: 2400 - DNA, 19 bp, Homo sapiens
aacggagcatgggagtgaa

SEQ ID NO: 2401 - DNA, 19 bp, Homo sapiens
agaagtgtcttcaaagctg

SEQ ID NO: 2402 - DNA, 19 bp, Homo sapiens
cattcaattgggagagaca

SEQ ID NO: 2403 - DNA, 19 bp, Homo sapiens
ccattcagtctctcaagac

SEQ ID NO: 2404 - DNA, 19 bp, Homo sapiens
cagataaaaaactcaccat

SEQ ID NO: 2405 - DNA, 19 bp, Homo sapiens
gctgttttgaagactctcc

SEQ ID NO: 2406 - DNA, 19 bp, Homo sapiens
cagaattcataatcccaac

SEQ ID NO: 2407 - DNA, 19 bp, Homo sapiens
actgcaagatttttcagac

SEQ ID NO: 2408 - DNA, 19 bp, Homo sapiens
caagaacctgttagttgct

SEQ ID NO: 2409 - DNA, 19 bp, Homo sapiens
gcacatcaatattgatcaa

SEQ ID NO: 2410 - DNA, 19 bp, Homo sapiens
tttcagatggcattgctgc

SEQ ID NO: 2411 - DNA, 19 bp, Homo sapiens
aaatcccatccaggttttc

SEQ ID NO: 2412 - DNA, 19 bp, Homo sapiens
tcctttggctgtgctttgt

SEQ ID NO: 2413 - DNA, 19 bp, Homo sapiens
agtgaagttctccagcaag

SEQ ID NO: 2414 - DNA, 19 bp, Homo sapiens
ccagaattcataatcccaa

SEQ ID NO: 2415 - DNA, 19 bp, Homo sapiens
ggctattgatgttagagtg

SEQ ID NO: 2416 - DNA, 19 bp, Homo sapiens
ggcatgatgctcatttaaa

SEQ ID NO: 2417 - DNA, 19 bp, Homo sapiens
taaagccattcagtctctc

SEQ ID NO: 2418 - DNA, 19 bp, Homo sapiens
tttaaccagtcagatattg

SEQ ID NO: 2419 - DNA, 19 bp, Homo sapiens
tttattgctgaatccaaaa

SEQ ID NO: 2420 - DNA, 19 bp, Homo sapiens
ttttgagaggaatcgacaa

SEQ ID NO: 2421 - DNA, 19 bp, Homo sapiens
gggaaaaaacaggcttgaa

SEQ ID NO: 2422 - DNA, 19 bp, Homo sapiens
ttctctctatgggaaaaaa

SEQ ID NO: 2423 - DNA, 19 bp, Homo sapiens
caaaagaagcccaagaggt

SEQ ID NO: 2424 - DNA, 19 bp, Homo sapiens
acaaagcagattatgttga

SEQ ID NO: 2425 - DNA, 19 bp, Homo sapiens
ttttcagaccaactctctg

SEQ ID NO: 2426 - DNA, 19 bp, Homo sapiens
ctgtctctggtcagccagg

SEQ ID NO: 2427 - DNA, 19 bp, Homo sapiens
attacacttcctttcgagt

SEQ ID NO: 2428 - DNA, 19 bp, Homo sapiens
tctcttcctccatggaatt

SEQ ID NO: 2429 - DNA, 19 bp, Homo sapiens
cttggagtgccagtttgaa

SEQ ID NO: 2430 - DNA, 19 bp, Homo sapiens
agagcttatgggatttcct

SEQ ID NO: 2431 - DNA, 19 bp, Homo sapiens
ttttggcaagctatacagt

SEQ ID NO: 2432 - DNA, 19 bp, Homo sapiens
ctttgtgagtttatcagtc

SEQ ID NO: 2433 - DNA, 19 bp, Homo sapiens
attggatatccaagatctg

SEQ ID NO: 2434 - DNA, 19 bp, Homo sapiens
ttaaaagaaatcttcaatt

SEQ ID NO: 2435 - DNA, 19 bp, Homo sapiens
tcaatgattatatcccata

SEQ ID NO: 2436 - DNA, 19 bp, Homo sapiens
agcacagaaaaaattcaaa

SEQ ID NO: 2437 - DNA, 19 bp, Homo sapiens
tagcacagaaaaaattcaa

SEQ ID NO: 2438 - DNA, 19 bp, Homo sapiens
aataaatggagtctttatt

SEQ ID NO: 2439 - DNA, 19 bp, Homo sapiens
caataccagaattcataat

SEQ ID NO: 2440 - DNA, 19 bp, Homo sapiens
tagtgattacacttccttt

SEQ ID NO: 2441 - DNA, 19 bp, Homo sapiens
atagcaacactaaatactt

SEQ ID NO: 2442 - DNA, 19 bp, Homo sapiens
atatccaagatgagatcaa

SEQ ID NO: 2443 - DNA, 19 bp, Homo sapiens
attgagattccctccatta

SEQ ID NO: 2444 - DNA, 19 bp, Homo sapiens
tggagtgccagtttgaaaa

SEQ ID NO: 2445 - DNA, 19 bp, Homo sapiens
atttcctaaagctggatgt

SEQ ID NO: 2446 - DNA, 19 bp, Homo sapiens
cactgttccagttgtcaat

SEQ ID NO: 2447 - DNA, 19 bp, Homo sapiens
cttcaaagacttaaaaaat

SEQ ID NO: 2448 - DNA, 19 bp, Homo sapiens
tgtaccataagccatattt

SEQ ID NO: 2449 - DNA, 19 bp, Homo sapiens
ttttctaaacttgaaattc

SEQ ID NO: 2450 - DNA, 19 bp, Homo sapiens
ttcttaaacattcctttaa

SEQ ID NO: 2451 - DNA, 19 bp, Homo sapiens
ttccaatttccctgtggat

SEQ ID NO: 2452 - DNA, 19 bp, Homo sapiens
aaagtgccacttttactca

SEQ ID NO: 2453 - DNA, 19 bp, Homo sapiens
caaatgacatgatgggctc

SEQ ID NO: 2454 - DNA, 19 bp, Homo sapiens
gattatatcccatatgttt

SEQ ID NO: 2455 - DNA, 19 bp, Homo sapiens
gaaggaaaagcgcacctca

SEQ ID NO: 2456 - DNA, 19 bp, Homo sapiens
tttgtggagggtagtcata

SEQ ID NO: 2457 - DNA, 19 bp, Homo sapiens
tggatgaagatgacgactt

SEQ ID NO: 2458 - DNA, 19 bp, Homo sapiens
gaataccaatgctgaactt

SEQ ID NO: 2459 - DNA, 19 bp, Homo sapiens
atctaaattcagttcttgt

SEQ ID NO: 2460 - DNA, 19 bp, Homo sapiens
caaaatagaagggaatctt

SEQ ID NO: 2461 - DNA, 19 bp, Homo sapiens
ctaaacttgaaattcaatc

SEQ ID NO: 2462 - DNA, 19 bp, Homo sapiens
aaatccgtgaggtgactca

SEQ ID NO: 2463 - DNA, 19 bp, Homo sapiens
caattttgagaatgaattt

SEQ ID NO: 2464 - DNA, 19 bp, Homo sapiens
agcatgcctagtttctcca

SEQ ID NO: 2465 - DNA, 19 bp, Homo sapiens
ttgtagatgaaaccaatga

SEQ ID NO: 2466 - DNA, 19 bp, Homo sapiens
tttgtagatgaaaccaatg

SEQ ID NO: 2467 - DNA, 19 bp, Homo sapiens
atttaagtatgatttcaat

SEQ ID NO: 2468 - DNA, 19 bp, Homo sapiens
aatttaagtatgatttcaa

SEQ ID NO: 2469 - DNA, 19 bp, Homo sapiens
gaatttaagtatgatttca

SEQ ID NO: 2470 - DNA, 19 bp, Homo sapiens
aattccctgaagttgatgt

SEQ ID NO: 2471 - DNA, 19 bp, Homo sapiens
caaattgaacatccccaaa

SEQ ID NO: 2472 - DNA, 19 bp, Homo sapiens
agtccccctaacagatttg

SEQ ID NO: 2473 - DNA, 19 bp, Homo sapiens
gagtgaaatgctgtttttt

SEQ ID NO: 2474 - DNA, 19 bp, Homo sapiens
ttgatgatatctggaacct

SEQ ID NO: 2475 - DNA, 19 bp, Homo sapiens
tccaatctcctcttttcac

SEQ ID NO: 2476 - DNA, 19 bp, Homo sapiens
tttcaagcaaatgcacaac

SEQ ID NO: 2477 - DNA, 19 bp, Homo sapiens
ccaatgctgaactttttaa

SEQ ID NO: 2478 - DNA, 19 bp, Homo sapiens
tctcctttcttcatcttca

SEQ ID NO: 2479 - DNA, 19 bp, Homo sapiens
aatgaagtccggattcatt

SEQ ID NO: 2480 - DNA, 19 bp, Homo sapiens
gttgagaagccccaagaat

SEQ ID NO: 2481 - DNA, 19 bp, Homo sapiens
tggcaagtaagtgctaggt

SEQ ID NO: 2482 - DNA, 19 bp, Homo sapiens
ctggacttctctagtcagg

SEQ ID NO: 2483 - DNA, 19 bp, Homo sapiens
gctaaaggagcagttgacc

SEQ ID NO: 2484 - DNA, 19 bp, Homo sapiens
aagtccggattcattctgg

SEQ ID NO: 2485 - DNA, 19 bp, Homo sapiens
tgacctgtccattcaaaac

SEQ ID NO: 2486 - DNA, 19 bp, Homo sapiens
agaaaaaggggattgaagt

SEQ ID NO: 2487 - DNA, 19 bp, Homo sapiens
gcaagttaaagaaaatcag

SEQ ID NO: 2488 - DNA, 19 bp, Homo sapiens
gctcatctcctttcttcat

SEQ ID NO: 2489 - DNA, 19 bp, Homo sapiens
tgctcatctcctttcttca

SEQ ID NO: 2490 - DNA, 19 bp, Homo sapiens
tttcaccatagaaggaccc

SEQ ID NO: 2491 - DNA, 19 bp, Homo sapiens
gtccccctaacagatttga

SEQ ID NO: 2492 - DNA, 19 bp, Homo sapiens
ggcaccagggctcggaagg

SEQ ID NO: 2493 - DNA, 19 bp, Homo sapiens
gcttgaaggaattcttgaa

SEQ ID NO: 2494 - DNA, 19 bp, Homo sapiens
tcttcataagttcaatgaa

SEQ ID NO: 2495 - DNA, 19 bp, Homo sapiens
ttttaacaaaagtggaagt

SEQ ID NO: 2496 - DNA, 19 bp, Homo sapiens
tggagaagcaaatctggat

SEQ ID NO: 2497 - DNA, 19 bp, Homo sapiens
tgttgaagtgtctccattc

SEQ ID NO: 2498 - DNA, 19 bp, Homo sapiens
aattccaattttgagaatg

SEQ ID NO: 2499 - DNA, 19 bp, Homo sapiens
ctgttgaaagatttatcaa

SEQ ID NO: 2500 - DNA, 19 bp, Homo sapiens
gaagttctcaattttgatt

SEQ ID NO: 2501 - DNA, 19 bp, Homo sapiens
ttcttctggaaaagggtca

SEQ ID NO: 2502 - DNA, 19 bp, Homo sapiens
agattctcagatgagggaa

SEQ ID NO: 2503 - DNA, 19 bp, Homo sapiens
tcagatggcattgctgctt

SEQ ID NO: 2504 - DNA, 19 bp, Homo sapiens
gagataaccgtgcctgaat

SEQ ID NO: 2505 - DNA, 19 bp, Homo sapiens
attttgaaaaaaacagaaa

SEQ ID NO: 2506 - DNA, 19 bp, Homo sapiens
ttccatcacaaatcctttg

SEQ ID NO: 2507 - DNA, 19 bp, Homo sapiens
actttacttcccaactctc

SEQ ID NO: 2508 - DNA, 19 bp, Homo sapiens
aactttacttcccaactct

SEQ ID NO: 2509 - DNA, 19 bp, Homo sapiens
ttgattcccttttttgaga

SEQ ID NO: 2510 - DNA, 19 bp, Homo sapiens
tgctgaatccaaaagattg

SEQ ID NO: 2511 - DNA, 19 bp, Homo sapiens
ggtttatcaaggggccatt

SEQ ID NO: 2512 - DNA, 19 bp, Homo sapiens
aggttccatcgtgcaaact

SEQ ID NO: 2513 - DNA, 19 bp, Homo sapiens
tgctccaggagaacttact

SEQ ID NO: 2514 - DNA, 19 bp, Homo sapiens
aactctcaagtcaagttga

SEQ ID NO: 2515 - DNA, 19 bp, Homo sapiens
tccattctgaatatattgt

SEQ ID NO: 2516 - DNA, 19 bp, Homo sapiens
attttctgaacttccccag

SEQ ID NO: 2517 - DNA, 19 bp, Homo sapiens
atctgatgaggaaactcag

SEQ ID NO: 2518 - DNA, 19 bp, Homo sapiens
ttcatgtccctagaaatct

SEQ ID NO: 2519 - DNA, 19 bp, Homo sapiens
tcaaggataacgtgtttga

SEQ ID NO: 2520 - DNA, 19 bp, Homo sapiens
ttgatgatgctgtcaagaa

SEQ ID NO: 2521 - DNA, 19 bp, Homo sapiens
cgacgaagaaaataatttc

SEQ ID NO: 2522 - DNA, 19 bp, Homo sapiens
ttccagaaagcagccagtg

SEQ ID NO: 2523 - DNA, 19 bp, Homo sapiens
cttccccaaagagaccagt

SEQ ID NO: 2524 - DNA, 19 bp, Homo sapiens
ctgattactatgaaaaatt

SEQ ID NO: 2525 - DNA, 19 bp, Homo sapiens
atggaaaagggaaagagaa

SEQ ID NO: 2526 - DNA, 19 bp, Homo sapiens
tggaagtgtcagtggcaaa

SEQ ID NO: 2527 - DNA, 19 bp, Homo sapiens
aggacctttcaaattcctg

SEQ ID NO: 2528 - DNA, 19 bp, Homo sapiens
aaatcaggatctgagttat

SEQ ID NO: 2529 - DNA, 19 bp, Homo sapiens
tccattctgaatatattgt

SEQ ID NO: 2530 - DNA, 19 bp, Homo sapiens
tgctggaattgtcattcct

SEQ ID NO: 2531 - DNA, 19 bp, Homo sapiens
taagttctctgtacctgct

SEQ ID NO: 2532 - DNA, 19 bp, Homo sapiens
ttcaaaacgagcttcagga

SEQ ID NO: 2533 - DNA, 19 bp, Homo sapiens
catttgatttaagtgtaaa

SEQ ID NO: 2534 - DNA, 19 bp, Homo sapiens
ggagacagcatcttcgtgt

SEQ ID NO: 2535 - DNA, 19 bp, Homo sapiens
tcccagaaaacctcttctt

SEQ ID NO: 2536 - DNA, 19 bp, Homo sapiens
ccttttacaattcattttc

SEQ ID NO: 2537 - DNA, 19 bp, Homo sapiens
ttttgagaatgaatttcaa

SEQ ID NO: 2538 - DNA, 19 bp, Homo sapiens
gttttggctgataaattca

SEQ ID NO: 2539 - DNA, 19 bp, Homo sapiens
gtttgataagtacaaagct

SEQ ID NO: 2540 - DNA, 19 bp, Homo sapiens
tgcctgagcagaccattga

SEQ ID NO: 2541 - DNA, 19 bp, Homo sapiens
aactttgcactatgttcat

SEQ ID NO: 2542 - DNA, 19 bp, Homo sapiens
aacacatgaatcacaaatt

SEQ ID NO: 2543 - DNA, 19 bp, Homo sapiens
tcaaaacgagcttcaggaa

SEQ ID NO: 2544 - DNA, 19 bp, Homo sapiens
atgggaagtataagaactt

SEQ ID NO: 2545 - DNA, 19 bp, Homo sapiens
agaaaaggcacaccttgac

SEQ ID NO: 2546 - DNA, 19 bp, Homo sapiens
gtaagaaaatacagagcag

SEQ ID NO: 2547 - DNA, 19 bp, Homo sapiens
agttgaaggagactattca

SEQ ID NO: 2548 - DNA, 19 bp, Homo sapiens
aaggaaacataaactaata

SEQ ID NO: 2549 - DNA, 19 bp, Homo sapiens
agaagaaatctgcagaaca

SEQ ID NO: 2550 - DNA, 19 bp, Homo sapiens
gcagtagactataagcaga

SEQ ID NO: 2551 - DNA, 19 bp, Homo sapiens
ctcagggatctgaaggtgg

SEQ ID NO: 2552 - DNA, 19 bp, Homo sapiens
atgaagtagaccaacaaat

SEQ ID NO: 2553 - DNA, 19 bp, Homo sapiens
gccacactccaacgcatat

SEQ ID NO: 2554 - DNA, 19 bp, Homo sapiens
ttttacaattcattttcca

SEQ ID NO: 2555 - DNA, 19 bp, Homo sapiens
agacctagtgattacactt

SEQ ID NO: 2556 - DNA, 19 bp, Homo sapiens
ccatgcaagtcagcccagt

SEQ ID NO: 2557 - DNA, 19 bp, Homo sapiens
ttaatcgagaggtatgaag

SEQ ID NO: 2558 - DNA, 19 bp, Homo sapiens
gagttgagggtccgggaat

SEQ ID NO: 2559 - DNA, 19 bp, Homo sapiens
aagcgcacctcaatatcaa

SEQ ID NO: 2560 - DNA, 19 bp, Homo sapiens
ggaactattgctagtgagg

SEQ ID NO: 2561 - DNA, 19 bp, Homo sapiens
ttgggaagaagaggcagct

SEQ ID NO: 2562 - DNA, 19 bp, Homo sapiens
gatatacactagggaggaa

SEQ ID NO: 2563 - DNA, 19 bp, Homo sapiens
gcttggttttgccagtctc

SEQ ID NO: 2564 - DNA, 19 bp, Homo sapiens
aagaggtatttaaagccat

SEQ ID NO: 2565 - DNA, 19 bp, Homo sapiens
caagaggtatttaaagcca

SEQ ID NO: 2566 - DNA, 19 bp, Homo sapiens
cttgggggaggaggaacaa

SEQ ID NO: 2567 - DNA, 19 bp, Homo sapiens
acttgggggaggaggaaca

SEQ ID NO: 2568 - DNA, 19 bp, Homo sapiens
ggaatctgatgaggaaact

SEQ ID NO: 2569 - DNA, 19 bp, Homo sapiens
ctggatgtaaccaccagca

SEQ ID NO: 2570 - DNA, 19 bp, Homo sapiens
tgatcaagaacctgttagt

SEQ ID NO: 2571 - DNA, 19 bp, Homo sapiens
ctgatcaagaacctgttag

SEQ ID NO: 2572 - DNA, 19 bp, Homo sapiens
ttttcagaccaactctctg

SEQ ID NO: 2573 - DNA, 19 bp, Homo sapiens
gaatttgaaagttcgtttt

SEQ ID NO: 2574 - DNA, 19 bp, Homo sapiens
gaaaacctatgccttaatc

SEQ ID NO: 2575 - DNA, 19 bp, Homo sapiens
tcaaaacctactgtctctt

SEQ ID NO: 2576 - DNA, 19 bp, Homo sapiens
aggacaccaaaataacctt

SEQ ID NO: 2577 - DNA, 19 bp, Homo sapiens
tgtcaacaagtaccactgg

SEQ ID NO: 2578 - DNA, 19 bp, Homo sapiens
gtttttaaattgttgaaag

SEQ ID NO: 2579 - DNA, 19 bp, Homo sapiens
aaaagggtcatggaaatgg

SEQ ID NO: 2580 - DNA, 19 bp, Homo sapiens
aagatagtcagtctgatca

SEQ ID NO: 2581 - DNA, 19 bp, Homo sapiens
atgagatcaacacaatctt

SEQ ID NO: 2582 - DNA, 19 bp, Homo sapiens
ttggtacgagttactcaaa

SEQ ID NO: 2583 - DNA, 19 bp, Homo sapiens
ctcaattttgattttcaag

SEQ ID NO: 2584 - DNA, 19 bp, Homo sapiens
cactcattgattttctgaa

SEQ ID NO: 2585 - DNA, 19 bp, Homo sapiens
agcagattatgttgaaaca

SEQ ID NO: 2586 - DNA, 19 bp, Homo sapiens
tcttttcagcccagccatt

SEQ ID NO: 2587 - DNA, 19 bp, Homo sapiens
atctgatgaggaaactcag

SEQ ID NO: 2588 - DNA, 19 bp, Homo sapiens
aatctgatgaggaaactca

SEQ ID NO: 2589 - DNA, 19 bp, Homo sapiens
ttaatcttcataagttcaa

SEQ ID NO: 2590 - DNA, 19 bp, Homo sapiens
tcaattgggagagacaagt

SEQ ID NO: 2591 - DNA, 19 bp, Homo sapiens
ctgagaacttcatcatttg

SEQ ID NO: 2592 - DNA, 19 bp, Homo sapiens
gatccaagtatagttggct

SEQ ID NO: 2593 - DNA, 19 bp, Homo sapiens
tggacctgcaccaaagctg

SEQ ID NO: 2594 - DNA, 19 bp, Homo sapiens
tctgatatacatcacggag

SEQ ID NO: 2595 - DNA, 19 bp, Homo sapiens
ttgagttgcccaccatcat

SEQ ID NO: 2596 - DNA, 19 bp, Homo sapiens
agcaagtctttcctggcct

SEQ ID NO: 2597 - DNA, 19 bp, Homo sapiens
ttgggagagacaagtttca

SEQ ID NO: 2598 - DNA, 19 bp, Homo sapiens
actttgcactatgttcata

SEQ ID NO: 2599 - DNA, 19 bp, Homo sapiens
atcaacacaatcttcaatg

SEQ ID NO: 2600 - DNA, 19 bp, Homo sapiens
cttggtacgagttactcaa

SEQ ID NO: 2601 - DNA, 19 bp, Homo sapiens
agtgattacacttcctttc

SEQ ID NO: 2602 - DNA, 19 bp, Homo sapiens
tttctgccactgctcagga

SEQ ID NO: 2603 - DNA, 19 bp, Homo sapiens
tcttccgttctgtaatggc

SEQ ID NO: 2604 - DNA, 19 bp, Homo sapiens
cctgcaccaaagctggcac

SEQ ID NO: 2605 - DNA, 19 bp, Homo sapiens
aatttattcaaaacgagct

SEQ ID NO: 2606 - DNA, 19 bp, Homo sapiens
ttaaaagaaatcttcaatt

SEQ ID NO: 2607 - DNA, 19 bp, Homo sapiens
ttctctctatgggaaaaaa

SEQ ID NO: 2608 - DNA, 19 bp, Homo sapiens
attgagattccctccatta

SEQ ID NO: 2609 - DNA, 19 bp, Homo sapiens
tataagcagaagcacatat

SEQ ID NO: 2610 - DNA, 19 bp, Homo sapiens
tcaaccttaatgattttca

SEQ ID NO: 2611 - DNA, 19 bp, Homo sapiens
tattcttcttttccaattg

SEQ ID NO: 2612 - DNA, 19 bp, Homo sapiens
gaaatcttcaatttattct

SEQ ID NO: 2613 - DNA, 19 bp, Homo sapiens
atcagttcagataaacttc

SEQ ID NO: 2614 - DNA, 19 bp, Homo sapiens
ttttgagaatgaatttcaa

SEQ ID NO: 2615 - DNA, 19 bp, Homo sapiens
aaattccttgacatgttga

SEQ ID NO: 2616 - DNA, 19 bp, Homo sapiens
gaagtgtcagtggcaaaaa

SEQ ID NO: 2617 - DNA, 19 bp, Homo sapiens
gcaagggttcactgttcct

SEQ ID NO: 2618 - DNA, 19 bp, Homo sapiens
ctccccaggacctttcaaa

SEQ ID NO: 2619 - DNA, 19 bp, Homo sapiens
ggccattccagaagggaag

SEQ ID NO: 2620 - DNA, 19 bp, Homo sapiens
tgccatctcgagagttcca

SEQ ID NO: 2621 - DNA, 19 bp, Homo sapiens
catgtcaaacactttgtta

SEQ ID NO: 2622 - DNA, 19 bp, Homo sapiens
tttgttataaatcttattg

SEQ ID NO: 2623 - DNA, 19 bp, Homo sapiens
tctggaaaagggtcatgga

SEQ ID NO: 2624 - DNA, 19 bp, Homo sapiens
cagctcttgttcaggtcca

SEQ ID NO: 2625 - DNA, 19 bp, Homo sapiens
ggaggttccccagctctgc

SEQ ID NO: 2626 - DNA, 19 bp, Homo sapiens
ctgttttgaagactctcca

SEQ ID NO: 2627 - DNA, 19 bp, Homo sapiens
agtggctgaaacgtgtgca

SEQ ID NO: 2628 - DNA, 19 bp, Homo sapiens
ccaaaatagaagggaatct

SEQ ID NO: 2629 - DNA, 19 bp, Homo sapiens
tgaagagaagattgaattt

SEQ ID NO: 2630 - DNA, 19 bp, Homo sapiens
agtggtggcaacaccagca

SEQ ID NO: 2631 - DNA, 19 bp, Homo sapiens
aaggctccacaagtcatca

SEQ ID NO: 2632 - DNA, 19 bp, Homo sapiens
gtcagccaggtttatagca

SEQ ID NO: 2633 - DNA, 19 bp, Homo sapiens
tgatatctggaaccttgaa

SEQ ID NO: 2634 - DNA, 19 bp, Homo sapiens
gtcaagttgagcaatttct

SEQ ID NO: 2635 - DNA, 19 bp, Homo sapiens
atccagatggaaaagggaa

SEQ ID NO: 2636 - DNA, 19 bp, Homo sapiens
atttgtttgtcaaagaagt

SEQ ID NO: 2637 - DNA, 19 bp, Homo sapiens
ctggaaaatgtcagcctgg

SEQ ID NO: 2638 - DNA, 19 bp, Homo sapiens
accaggaggttcttcttca

SEQ ID NO: 2639 - DNA, 19 bp, Homo sapiens
aaagaagttctgaaagaat

SEQ ID NO: 2640 - DNA, 19 bp, Homo sapiens
gctacagcttatggctcca

SEQ ID NO: 2641 - DNA, 19 bp, Homo sapiens
atcaatattgatcaatttg

SEQ ID NO: 2642 - DNA, 19 bp, Homo sapiens
gaattatcttttaaaacat

SEQ ID NO: 2643 - DNA, 19 bp, Homo sapiens
cgaggcccgcgctgctggc

SEQ ID NO: 2644 - DNA, 19 bp, Homo sapiens
acaactatgaggctgagag

SEQ ID NO: 2645 - DNA, 19 bp, Homo sapiens
gctgagagttccagtggag

SEQ ID NO: 2646 - DNA, 19 bp, Homo sapiens
tgaagaaaaccaagaactc

SEQ ID NO: 2647 - DNA, 19 bp, Homo sapiens
cctacttacatcctgaaca

SEQ ID NO: 2648 - DNA, 19 bp, Homo sapiens
ctacttacatcctgaacat

SEQ ID NO: 2649 - DNA, 19 bp, Homo sapiens
gagacagaagaagccaagc

SEQ ID NO: 2650 - DNA, 19 bp, Homo sapiens
cactcactttaccgtcaag

SEQ ID NO: 2651 - DNA, 19 bp, Homo sapiens
ctgatcagcagcagccagt

SEQ ID NO: 2652 - DNA, 19 bp, Homo sapiens
actggacgctaagaggaag

SEQ ID NO: 2653 - DNA, 19 bp, Homo sapiens
agaggaagcatgtggcaga

SEQ ID NO: 2654 - DNA, 19 bp, Homo sapiens
tgaagactctccaggaact

SEQ ID NO: 2655 - DNA, 19 bp, Homo sapiens
ctctgagcaaaatatccag

SEQ ID NO: 2656 - DNA, 19 bp, Homo sapiens
atgaagcagtcacatctct

SEQ ID NO: 2657 - DNA, 19 bp, Homo sapiens
ttgccacagctgattgagg

SEQ ID NO: 2658 - DNA, 19 bp, Homo sapiens
agctgattgaggtgtccag

SEQ ID NO: 2659 - DNA, 19 bp, Homo sapiens
tgctccactcacatcctcc

SEQ ID NO: 2660 - DNA, 19 bp, Homo sapiens
tgaaacgtgtgcatgccaa

SEQ ID NO: 2661 - DNA, 19 bp, Homo sapiens
gacattgctaattacctga

SEQ ID NO: 2662 - DNA, 19 bp, Homo sapiens
ttcttcttcagactttcct

SEQ ID NO: 2663 - DNA, 19 bp, Homo sapiens
ccaatatcttgaactcaga

SEQ ID NO: 2664 - DNA, 19 bp, Homo sapiens
aaagttagtgaaagaagtt

SEQ ID NO: 2665 - DNA, 19 bp, Homo sapiens
aagttagtgaaagaagttc

SEQ ID NO: 2666 - DNA, 19 bp, Homo sapiens
aaagaagttctgaaagaat

SEQ ID NO: 2667 - DNA, 19 bp, Homo sapiens
tttggctataccaaagatg

SEQ ID NO: 2668 - DNA, 19 bp, Homo sapiens
tgttgagaagctgattaaa

SEQ ID NO: 2669 - DNA, 19 bp, Homo sapiens
caggaagggctcaaagaat

SEQ ID NO: 2670 - DNA, 19 bp, Homo sapiens
aggaagggctcaaagaatg

SEQ ID NO: 2671 - DNA, 19 bp, Homo sapiens
gaagggctcaaagaatgac

SEQ ID NO: 2672 - DNA, 19 bp, Homo sapiens
caaagaatgacttttttct

SEQ ID NO: 2673 - DNA, 19 bp, Homo sapiens
catggagaatgcctttgaa

SEQ ID NO: 2674 - DNA, 19 bp, Homo sapiens
ggagccaaggctggagtaa

SEQ ID NO: 2675 - DNA, 19 bp, Homo sapiens
tcattccttccccaaagag

SEQ ID NO: 2676 - DNA, 19 bp, Homo sapiens
acctatgagctccagagag

SEQ ID NO: 2677 - DNA, 19 bp, Homo sapiens
gggcaaaacgtcttacaga

SEQ ID NO: 2678 - DNA, 19 bp, Homo sapiens
accctggacattcagaaca

SEQ ID NO: 2679 - DNA, 19 bp, Homo sapiens
atgggcgacctaagttgtg

SEQ ID NO: 2680 - DNA, 19 bp, Homo sapiens
gatgaagagaagattgaat

SEQ ID NO: 2681 - DNA, 19 bp, Homo sapiens
caatgtagataccaaaaaa

SEQ ID NO: 2682 - DNA, 19 bp, Homo sapiens
gtagataccaaaaaaatga

SEQ ID NO: 2683 - DNA, 19 bp, Homo sapiens
gcttcagttcatttggact

SEQ ID NO: 2684 - DNA, 19 bp, Homo sapiens
tttgtttgtcaaagaagtc

SEQ ID NO: 2685 - DNA, 19 bp, Homo sapiens
ttgtttgtcaaagaagtca

SEQ ID NO: 2686 - DNA, 19 bp, Homo sapiens
tggcaatgggaaactcgct

SEQ ID NO: 2687 - DNA, 19 bp, Homo sapiens
aacctctggcatttacttt

SEQ ID NO: 2688 - DNA, 19 bp, Homo sapiens
catttactttctctcatga

SEQ ID NO: 2689 - DNA, 19 bp, Homo sapiens
aaagtcagtgccctgctta

SEQ ID NO: 2690 - DNA, 19 bp, Homo sapiens
tcccattttttgagacctt

SEQ ID NO: 2691 - DNA, 19 bp, Homo sapiens
catcaatattgatcaattt

SEQ ID NO: 2692 - DNA, 19 bp, Homo sapiens
taaagatagttatgattta

SEQ ID NO: 2693 - DNA, 19 bp, Homo sapiens
tattgatgaaatcattgaa

SEQ ID NO: 2694 - DNA, 19 bp, Homo sapiens
atgatctacatttgtttat

SEQ ID NO: 2695 - DNA, 19 bp, Homo sapiens
agagacacatacagaatat

SEQ ID NO: 2696 - DNA, 19 bp, Homo sapiens
gacacatacagaatataga

SEQ ID NO: 2697 - DNA, 19 bp, Homo sapiens
agcatgtcaaacactttgt

SEQ ID NO: 2698 - DNA, 19 bp, Homo sapiens
tttttagaggaaaccaagg

SEQ ID NO: 2699 - DNA, 19 bp, Homo sapiens
ttttagaggaaaccaaggc

SEQ ID NO: 2700 - DNA, 19 bp, Homo sapiens
ggaagatagacttcctgaa

SEQ ID NO: 2701 - DNA, 19 bp, Homo sapiens
cactgtttctgagtcccag

SEQ ID NO: 2702 - DNA, 19 bp, Homo sapiens
cacaaatcctttggctgtg

SEQ ID NO: 2703 - DNA, 19 bp, Homo sapiens
ttcctggatacactgttcc

SEQ ID NO: 2704 - DNA, 19 bp, Homo sapiens
gaaatctcaagctttctct

SEQ ID NO: 2705 - DNA, 19 bp, Homo sapiens
tttcttcatcttcatctgt

SEQ ID NO: 2706 - DNA, 19 bp, Homo sapiens
tctaccgctaaaggagcag

SEQ ID NO: 2707 - DNA, 19 bp, Homo sapiens
ctaccgctaaaggagcagt

SEQ ID NO: 2708 - DNA, 19 bp, Homo sapiens
agggcctctttttcaccaa

SEQ ID NO: 2709 - DNA, 19 bp, Homo sapiens
ttctccatccctgtaaaag

SEQ ID NO: 2710 - DNA, 19 bp, Homo sapiens
gaaaaacaaagcagattat

SEQ ID NO: 2711 - DNA, 19 bp, Homo sapiens
actcactcattgattttct

SEQ ID NO: 2712 - DNA, 19 bp, Homo sapiens
taaactaatagatgtaatc

SEQ ID NO: 2713 - DNA, 19 bp, Homo sapiens
caaaacgagcttcaggaag

SEQ ID NO: 2714 - DNA, 19 bp, Homo sapiens
tggaataatgctcagtgtt

SEQ ID NO: 2715 - DNA, 19 bp, Homo sapiens
gatttgaaatccaaagaag

SEQ ID NO: 2716 - DNA, 19 bp, Homo sapiens
atttgaaatccaaagaagt

SEQ ID NO: 2717 - DNA, 19 bp, Homo sapiens
atcaacagccgcttctttg

SEQ ID NO: 2718 - DNA, 19 bp, Homo sapiens
tgttttgaagactctccag

SEQ ID NO: 2719 - DNA, 19 bp, Homo sapiens
cccttctgatagatgtggt

SEQ ID NO: 2720 - DNA, 19 bp, Homo sapiens
tgagcaagtgaagaacttt

SEQ ID NO: 2721 - DNA, 19 bp, Homo sapiens
atttgaaatccaaagaagt

SEQ ID NO: 2722 - DNA, 19 bp, Homo sapiens
atccaaagaagtcccggaa

SEQ ID NO: 2723 - DNA, 19 bp, Homo sapiens
agagcctacctccgcatct

SEQ ID NO: 2724 - DNA, 19 bp, Homo sapiens
aatgcctttgaactcccca

SEQ ID NO: 2725 - DNA, 19 bp, Homo sapiens
gaagtccaaattccggatt

SEQ ID NO: 2726 - DNA, 19 bp, Homo sapiens
tgcaagcagaagccagaag

SEQ ID NO: 2727 - DNA, 19 bp, Homo sapiens
gaagagaagattgaatttg

SEQ ID NO: 2728 - DNA, 19 bp, Homo sapiens
atgctaaaggcacatatgg

SEQ ID NO: 2729 - DNA, 19 bp, Homo sapiens
tccctcacctccacctctg

SEQ ID NO: 2730 - DNA, 19 bp, Homo sapiens
atttacagctctgacaagt

SEQ ID NO: 2731 - DNA, 19 bp, Homo sapiens
aggagcctaccaaaataat

SEQ ID NO: 2732 - DNA, 19 bp, Homo sapiens
aaagctgaagcacatcaat

SEQ ID NO: 2733 - DNA, 19 bp, Homo sapiens
ctgctggaaacaacgagaa

SEQ ID NO: 2734 - DNA, 19 bp, Homo sapiens
ttgaaggaattcttgaaaa

SEQ ID NO: 2735 - DNA, 19 bp, Homo sapiens
gaagtaaaagaaaattttg

SEQ ID NO: 2736 - DNA, 19 bp, Homo sapiens
tgaagaagatggcaaattt

SEQ ID NO: 2737 - DNA, 19 bp, Homo sapiens
aggatctgagttattttgc

SEQ ID NO: 2738 - DNA, 19 bp, Homo sapiens
gtgcccttctcggttgctg

SEQ ID NO: 2739 - DNA, 19 bp, Homo sapiens
ggcgctgcctgcgctgctg

SEQ ID NO: 2740 - DNA, 19 bp, Homo sapiens
ctgcgctgctgctgctgct

SEQ ID NO: 2741 - DNA, 19 bp, Homo sapiens
gctgctggcgggcgccagg

SEQ ID NO: 2742 - DNA, 19 bp, Homo sapiens
aagaggaaatgctggaaaa

SEQ ID NO: 2743 - DNA, 19 bp, Homo sapiens
ctggaaaatgtcagcctgg

SEQ ID NO: 2744 - DNA, 19 bp, Homo sapiens
tggagtccctgggactgct

SEQ ID NO: 2745 - DNA, 19 bp, Homo sapiens
ggagtccctgggactgctg

SEQ ID NO: 2746 - DNA, 19 bp, Homo sapiens
tgggactgctgattcaaga

SEQ ID NO: 2747 - DNA, 19 bp, Homo sapiens
ctgctgattcaagaagtgc

SEQ ID NO: 2748 - DNA, 19 bp, Homo sapiens
tgccaccaggatcaactgc

SEQ ID NO: 2749 - DNA, 19 bp, Homo sapiens
gccaccaggatcaactgca

SEQ ID NO: 2750 - DNA, 19 bp, Homo sapiens
tgcaaggttgagctggagg

SEQ ID NO: 2751 - DNA, 19 bp, Homo sapiens
caaggttgagctggaggtt

SEQ ID NO: 2752 - DNA, 19 bp, Homo sapiens
ctctgcagcttcatcctga

SEQ ID NO: 2753 - DNA, 19 bp, Homo sapiens
cagcttcatcctgaagacc

SEQ ID NO: 2754 - DNA, 19 bp, Homo sapiens
gcttcatcctgaagaccag

SEQ ID NO: 2755 - DNA, 19 bp, Homo sapiens
tcatcctgaagaccagcca

SEQ ID NO: 2756 - DNA, 19 bp, Homo sapiens
gaaaaccaagaactctgag

SEQ ID NO: 2757 - DNA, 19 bp, Homo sapiens
agaactctgaggagtttgc

SEQ ID NO: 2758 - DNA, 19 bp, Homo sapiens
tctgaggagtttgctgcag

SEQ ID NO: 2759 - DNA, 19 bp, Homo sapiens
tttgctgcagccatgtcca

SEQ ID NO: 2760 - DNA, 19 bp, Homo sapiens
caagaggggcatcatttct

SEQ ID NO: 2761 - DNA, 19 bp, Homo sapiens
tcactttaccgtcaagacg

SEQ ID NO: 2762 - DNA, 19 bp, Homo sapiens
tttaccgtcaagacgagga

SEQ ID NO: 2763 - DNA, 19 bp, Homo sapiens
cactggacgctaagaggaa

SEQ ID NO: 2764 - DNA, 19 bp, Homo sapiens
aggaagcatgtggcagaag

SEQ ID NO: 2765 - DNA, 19 bp, Homo sapiens
caaggagcaacacctcttc

SEQ ID NO: 2766 - DNA, 19 bp, Homo sapiens
acagactttgaaacttgaa

SEQ ID NO: 2767 - DNA, 19 bp, Homo sapiens
tgatgaagcagtcacatct

SEQ ID NO: 2768 - DNA, 19 bp, Homo sapiens
agcagtcacatctctcttg

SEQ ID NO: 2769 - DNA, 19 bp, Homo sapiens
ccagccccatcactttaca

SEQ ID NO: 2770 - DNA, 19 bp, Homo sapiens
ctccactcacatcctccag

SEQ ID NO: 2771 - DNA, 19 bp, Homo sapiens
catgccaacccccttctga

SEQ ID NO: 2772 - DNA, 19 bp, Homo sapiens
gagagatcttcaacatggc

SEQ ID NO: 2773 - DNA, 19 bp, Homo sapiens
tcaacatggcgagggatca

SEQ ID NO: 2774 - DNA, 19 bp, Homo sapiens
ccaccttgtatgcgctgag

SEQ ID NO: 2775 - DNA, 19 bp, Homo sapiens
gtcaacaactatcataaga

SEQ ID NO: 2776 - DNA, 19 bp, Homo sapiens
tggacattgctaattacct

SEQ ID NO: 2777 - DNA, 19 bp, Homo sapiens
ggacattgctaattacctg

SEQ ID NO: 2778 - DNA, 19 bp, Homo sapiens
ttctgcgggtcattggaaa

SEQ ID NO: 2779 - DNA, 19 bp, Homo sapiens
ccagaactcaagtcttcaa

SEQ ID NO: 2780 - DNA, 19 bp, Homo sapiens
agtcttcaatcctgaaatg

SEQ ID NO: 2781 - DNA, 19 bp, Homo sapiens
tgagcaagtgaagaacttt

SEQ ID NO: 2782 - DNA, 19 bp, Homo sapiens
agcaagtgaagaactttgt

SEQ ID NO: 2783 - DNA, 19 bp, Homo sapiens
tctgaaagaatctcaactt

SEQ ID NO: 2784 - DNA, 19 bp, Homo sapiens
actgtcatggacttcagaa

SEQ ID NO: 2785 - DNA, 19 bp, Homo sapiens
acttgacccagcctcagcc

SEQ ID NO: 2786 - DNA, 19 bp, Homo sapiens
tccaaataactaccttcct

SEQ ID NO: 2787 - DNA, 19 bp, Homo sapiens
actaccctcactgcctttg

SEQ ID NO: 2788 - DNA, 19 bp, Homo sapiens
ttggatttgcttcagctga

SEQ ID NO: 2789 - DNA, 19 bp, Homo sapiens
ttggaagctctttttggga

SEQ ID NO: 2790 - DNA, 19 bp, Homo sapiens
ggaagctctttttgggaag

SEQ ID NO: 2791 - DNA, 19 bp, Homo sapiens
tttttcccagacagtgtca

SEQ ID NO: 2792 - DNA, 19 bp, Homo sapiens
agacagtgtcaacaaagct

SEQ ID NO: 2793 - DNA, 19 bp, Homo sapiens
ctttggctataccaaagat

SEQ ID NO: 2794 - DNA, 19 bp, Homo sapiens
caaagatgataaacatgag

SEQ ID NO: 2795 - DNA, 19 bp, Homo sapiens
gatatggtaaatggaataa

SEQ ID NO: 2796 - DNA, 19 bp, Homo sapiens
ggaataatgctcagtgttg

SEQ ID NO: 2797 - DNA, 19 bp, Homo sapiens
tttgaaatccaaagaagtc

SEQ ID NO: 2798 - DNA, 19 bp, Homo sapiens
gatcccccagatgattgga

SEQ ID NO: 2799 - DNA, 19 bp, Homo sapiens
cagatgattggagaggtca

SEQ ID NO: 2800 - DNA, 19 bp, Homo sapiens
agaatgacttttttcttca

SEQ ID NO: 2801 - DNA, 19 bp, Homo sapiens
gaactccccactggagctg

SEQ ID NO: 2802 - DNA, 19 bp, Homo sapiens
atatcttcatctggagtca

SEQ ID NO: 2803 - DNA, 19 bp, Homo sapiens
gtcattgctcccggagcca

SEQ ID NO: 2804 - DNA, 19 bp, Homo sapiens
gctgaagtttatcattcct

SEQ ID NO: 2805 - DNA, 19 bp, Homo sapiens
attccttccccaaagagac

SEQ ID NO: 2806 - DNA, 19 bp, Homo sapiens
ctcattgagaacaggcagt

SEQ ID NO: 2807 - DNA, 19 bp, Homo sapiens
ttgagcagtattctgtcag

SEQ ID NO: 2808 - DNA, 19 bp, Homo sapiens
accttgtccagtgaagtcc

SEQ ID NO: 2809 - DNA, 19 bp, Homo sapiens
ccagtgaagtccaaattcc

SEQ ID NO: 2810 - DNA, 19 bp, Homo sapiens
acattcagaacaagaaaat

SEQ ID NO: 2811 - DNA, 19 bp, Homo sapiens
gaaaaatcaagggtgttat

SEQ ID NO: 2812 - DNA, 19 bp, Homo sapiens
aaatcaagggtgttatttc

SEQ ID NO: 2813 - DNA, 19 bp, Homo sapiens
tggcattatgatgaagaga

SEQ ID NO: 2814 - DNA, 19 bp, Homo sapiens
aagagaagattgaatttga

SEQ ID NO: 2815 - DNA, 19 bp, Homo sapiens
aaatgacttccaatttccc

SEQ ID NO: 2816 - DNA, 19 bp, Homo sapiens
atgacttccaatttccctg

SEQ ID NO: 2817 - DNA, 19 bp, Homo sapiens
acttccaatttccctgtgg

SEQ ID NO: 2818 - DNA, 19 bp, Homo sapiens
agttgcaatgagctcatgg

SEQ ID NO: 2819 - DNA, 19 bp, Homo sapiens
tttgcaagaccacctcaat

SEQ ID NO: 2820 - DNA, 19 bp, Homo sapiens
gaaggagttcaacctccag

SEQ ID NO: 2821 - DNA, 19 bp, Homo sapiens
acttccacatcccagaaaa

SEQ ID NO: 2822 - DNA, 19 bp, Homo sapiens
ctcttcttaaaaagcgatg

SEQ ID NO: 2823 - DNA, 19 bp, Homo sapiens
aaaagcgatggccgggtca

SEQ ID NO: 2824 - DNA, 19 bp, Homo sapiens
ttcctttgccttttggtgg

SEQ ID NO: 2825 - DNA, 19 bp, Homo sapiens
caagtctgtgggattccat

SEQ ID NO: 2826 - DNA, 19 bp, Homo sapiens
aagtccctacttttaccat

SEQ ID NO: 2827 - DNA, 19 bp, Homo sapiens
tgcctctcctgggtgttct

SEQ ID NO: 2828 - DNA, 19 bp, Homo sapiens
accagcacagaccatttca

SEQ ID NO: 2829 - DNA, 19 bp, Homo sapiens
ccagcacagaccatttcag

SEQ ID NO: 2830 - DNA, 19 bp, Homo sapiens
actatcatgtgatgggtct

SEQ ID NO: 2831 - DNA, 19 bp, Homo sapiens
accacagatgtctgcttca

SEQ ID NO: 2832 - DNA, 19 bp, Homo sapiens
ccacagatgtctgcttcag

SEQ ID NO: 2833 - DNA, 19 bp, Homo sapiens
tttggactccaaaaagaaa

SEQ ID NO: 2834 - DNA, 19 bp, Homo sapiens
tcaaagaagtcaagattga

SEQ ID NO: 2835 - DNA, 19 bp, Homo sapiens
atgagaactacgagctgac

SEQ ID NO: 2836 - DNA, 19 bp, Homo sapiens
ttaaaatctgacaccaatg

SEQ ID NO: 2837 - DNA, 19 bp, Homo sapiens
gaagtataagaactttgcc

SEQ ID NO: 2838 - DNA, 19 bp, Homo sapiens
aagtataagaactttgcca

SEQ ID NO: 2839 - DNA, 19 bp, Homo sapiens
ttcttcagcctgctttctg

SEQ ID NO: 2840 - DNA, 19 bp, Homo sapiens
ctggatcactaaattccca

SEQ ID NO: 2841 - DNA, 19 bp, Homo sapiens
aaattaatagtggtgctca

SEQ ID NO: 2842 - DNA, 19 bp, Homo sapiens
agtgcaacgaccaacttga

SEQ ID NO: 2843 - DNA, 19 bp, Homo sapiens
ctgggaagtgcttatcagg

SEQ ID NO: 2844 - DNA, 19 bp, Homo sapiens
gcaaaaacattttcaactt

SEQ ID NO: 2845 - DNA, 19 bp, Homo sapiens
aaaaacattttcaacttca

SEQ ID NO: 2846 - DNA, 19 bp, Homo sapiens
tcagtcaagaaggacttaa

SEQ ID NO: 2847 - DNA, 19 bp, Homo sapiens
tcaaatgacatgatgggct

SEQ ID NO: 2848 - DNA, 19 bp, Homo sapiens
cacacaaacagtctgaaca

SEQ ID NO: 2849 - DNA, 19 bp, Homo sapiens
tcttcaaaacttgacaaca

SEQ ID NO: 2850 - DNA, 19 bp, Homo sapiens
caagttttataagcaaact

SEQ ID NO: 2851 - DNA, 19 bp, Homo sapiens
tggtaactactttaaacag

SEQ ID NO: 2852 - DNA, 19 bp, Homo sapiens
aacagtgacctgaaataca

SEQ ID NO: 2853 - DNA, 19 bp, Homo sapiens
gggaaactacggctagaac

SEQ ID NO: 2854 - DNA, 19 bp, Homo sapiens
aacacatctatgccatctc

SEQ ID NO: 2855 - DNA, 19 bp, Homo sapiens
tcagcaagctataaagcag

SEQ ID NO: 2856 - DNA, 19 bp, Homo sapiens
gcagacactgttgctaagg

SEQ ID NO: 2857 - DNA, 19 bp, Homo sapiens
tctggggagaacatactgg

SEQ ID NO: 2858 - DNA, 19 bp, Homo sapiens
ttctctcatgattacaaag

SEQ ID NO: 2859 - DNA, 19 bp, Homo sapiens
ctgagcagacaggcacctg

SEQ ID NO: 2860 - DNA, 19 bp, Homo sapiens
caatttaacaacaatgaat

SEQ ID NO: 2861 - DNA, 19 bp, Homo sapiens
tggacgaactctggctgac

SEQ ID NO: 2862 - DNA, 19 bp, Homo sapiens
cttttactcagtgagccca

SEQ ID NO: 2863 - DNA, 19 bp, Homo sapiens
tcattgatgctttagagat

SEQ ID NO: 2864 - DNA, 19 bp, Homo sapiens
aaaaccaagatgttcactc

SEQ ID NO: 2865 - DNA, 19 bp, Homo sapiens
aggaatcgacaaaccatta

SEQ ID NO: 2866 - DNA, 19 bp, Homo sapiens
tagttgtactggaaaacgt

SEQ ID NO: 2867 - DNA, 19 bp, Homo sapiens
ggaaaacgtacagagaaag

SEQ ID NO: 2868 - DNA, 19 bp, Homo sapiens
gaaaacgtacagagaaagc

SEQ ID NO: 2869 - DNA, 19 bp, Homo sapiens
aaagctgaagcacatcaat

SEQ ID NO: 2870 - DNA, 19 bp, Homo sapiens
aagctgaagcacatcaata

SEQ ID NO: 2871 - DNA, 19 bp, Homo sapiens
tgaagcacatcaatattga

SEQ ID NO: 2872 - DNA, 19 bp, Homo sapiens
atcaatattgatcaatttg

SEQ ID NO: 2873 - DNA, 19 bp, Homo sapiens
taatgattatctgaattca

SEQ ID NO: 2874 - DNA, 19 bp, Homo sapiens
gattatctgaattcattca

SEQ ID NO: 2875 - DNA, 19 bp, Homo sapiens
aattgggagagacaagttt

SEQ ID NO: 2876 - DNA, 19 bp, Homo sapiens
aaaatagctattgctaata

SEQ ID NO: 2877 - DNA, 19 bp, Homo sapiens
aaaattaaaaagtcttgat

SEQ ID NO: 2878 - DNA, 19 bp, Homo sapiens
ttgaaaatattgattttaa

SEQ ID NO: 2879 - DNA, 19 bp, Homo sapiens
agacatccagcacctagct

SEQ ID NO: 2880 - DNA, 19 bp, Homo sapiens
caatttcatttgaaagaat

SEQ ID NO: 2881 - DNA, 19 bp, Homo sapiens
aggttttaatggataaatt

SEQ ID NO: 2882 - DNA, 19 bp, Homo sapiens
cagaagctaagcaatgtcc

SEQ ID NO: 2883 - DNA, 19 bp, Homo sapiens
taagataaaagattacttt

SEQ ID NO: 2884 - DNA, 19 bp, Homo sapiens
aaagattactttgagaaat

SEQ ID NO: 2885 - DNA, 19 bp, Homo sapiens
gagaaattagttggattta

SEQ ID NO: 2886 - DNA, 19 bp, Homo sapiens
atttattgatgatgctgtc

SEQ ID NO: 2887 - DNA, 19 bp, Homo sapiens
gaattatcttttaaaacat

SEQ ID NO: 2888 - DNA, 19 bp, Homo sapiens
ttaccaccagtttgtagat

SEQ ID NO: 2889 - DNA, 19 bp, Homo sapiens
ttgcagtgtatctggaaag

SEQ ID NO: 2890 - DNA, 19 bp, Homo sapiens
cattcagcaggaacttcaa

SEQ ID NO: 2891 - DNA, 19 bp, Homo sapiens
acacctgattttatagtcc

SEQ ID NO: 2892 - DNA, 19 bp, Homo sapiens
ggattccatcagttcagat

SEQ ID NO: 2893 - DNA, 19 bp, Homo sapiens
ttgtagaaatgaaagtaaa

SEQ ID NO: 2894 - DNA, 19 bp, Homo sapiens
ctgaacagtgagctgcagt

SEQ ID NO: 2895 - DNA, 19 bp, Homo sapiens
aatccaatctcctcttttc

SEQ ID NO: 2896 - DNA, 19 bp, Homo sapiens
attttgattttcaagcaaa

SEQ ID NO: 2897 - DNA, 19 bp, Homo sapiens
ttttgattttcaagcaaat

SEQ ID NO: 2898 - DNA, 19 bp, Homo sapiens
tgattttcaagcaaatgca

SEQ ID NO: 2899 - DNA, 19 bp, Homo sapiens
atgctgttttttggaaatg

SEQ ID NO: 2900 - DNA, 19 bp, Homo sapiens
tgctgttttttggaaatgc

SEQ ID NO: 2901 - DNA, 19 bp, Homo sapiens
aaaaaaatacactggagct

SEQ ID NO: 2902 - DNA, 19 bp, Homo sapiens
actggagcttagtaatgga

SEQ ID NO: 2903 - DNA, 19 bp, Homo sapiens
cttctggaaaagggtcatg

SEQ ID NO: 2904 - DNA, 19 bp, Homo sapiens
ggaaaagggtcatggaaat

SEQ ID NO: 2905 - DNA, 19 bp, Homo sapiens
gggcctgccccagattctc

SEQ ID NO: 2906 - DNA, 19 bp, Homo sapiens
ttctcagatgagggaacac

SEQ ID NO: 2907 - DNA, 19 bp, Homo sapiens
gatgagggaacacatgaat

SEQ ID NO: 2908 - DNA, 19 bp, Homo sapiens
ctttggactgtccaataag

SEQ ID NO: 2909 - DNA, 19 bp, Homo sapiens
gcatccacaaacaatgaag

SEQ ID NO: 2910 - DNA, 19 bp, Homo sapiens
cacaaacaatgaagggaat

SEQ ID NO: 2911 - DNA, 19 bp, Homo sapiens
ccaaaatttctctgctgga

SEQ ID NO: 2912 - DNA, 19 bp, Homo sapiens
caaaatttctctgctggaa

SEQ ID NO: 2913 - DNA, 19 bp, Homo sapiens
tctgctggaaacaacgaga

SEQ ID NO: 2914 - DNA, 19 bp, Homo sapiens
ctgctggaaacaacgagaa

SEQ ID NO: 2915 - DNA, 19 bp, Homo sapiens
agaacattatggaggccca

SEQ ID NO: 2916 - DNA, 19 bp, Homo sapiens
agaagcaaatctggatttc

SEQ ID NO: 2917 - DNA, 19 bp, Homo sapiens
tttctctctatgggaaaaa

SEQ ID NO: 2918 - DNA, 19 bp, Homo sapiens
tcagagcatcaaatccttt

SEQ ID NO: 2919 - DNA, 19 bp, Homo sapiens
cagaaacaatgcattagat

SEQ ID NO: 2920 - DNA, 19 bp, Homo sapiens
tacacattaatcctgccat

SEQ ID NO: 2921 - DNA, 19 bp, Homo sapiens
agtcagatattgttgctca

SEQ ID NO: 2922 - DNA, 19 bp, Homo sapiens
ggagggtagtcataacagt

SEQ ID NO: 2923 - DNA, 19 bp, Homo sapiens
caaaagccgaaattccaat

SEQ ID NO: 2924 - DNA, 19 bp, Homo sapiens
aaaagccgaaattccaatt

SEQ ID NO: 2925 - DNA, 19 bp, Homo sapiens
ttcaagcaagaacttaatg

SEQ ID NO: 2926 - DNA, 19 bp, Homo sapiens
cctcttacttttccattga

SEQ ID NO: 2927 - DNA, 19 bp, Homo sapiens
tgaggccaacacttacttg

SEQ ID NO: 2928 - DNA, 19 bp, Homo sapiens
cacttacttgaattccaag

SEQ ID NO: 2929 - DNA, 19 bp, Homo sapiens
gaagtaaaagaaaattttg

SEQ ID NO: 2930 - DNA, 19 bp, Homo sapiens
cctggaactctctccatgg

SEQ ID NO: 2931 - DNA, 19 bp, Homo sapiens
agctggatgtaaccaccag

SEQ ID NO: 2932 - DNA, 19 bp, Homo sapiens
aaaattccctgaagttgat

SEQ ID NO: 2933 - DNA, 19 bp, Homo sapiens
cagatggcattgctgcttt

SEQ ID NO: 2934 - DNA, 19 bp, Homo sapiens
agatggcattgctgctttg

SEQ ID NO: 2935 - DNA, 19 bp, Homo sapiens
tgttgaaacagtcctggat

SEQ ID NO: 2936 - DNA, 19 bp, Homo sapiens
catattcaaaactgagttg

SEQ ID NO: 2937 - DNA, 19 bp, Homo sapiens
aaagatttatcaaaagaag

SEQ ID NO: 2938 - DNA, 19 bp, Homo sapiens
attttccaactaatagaag

SEQ ID NO: 2939 - DNA, 19 bp, Homo sapiens
aattatatccaagatgaga

SEQ ID NO: 2940 - DNA, 19 bp, Homo sapiens
ttcaggaagcttctcaaga

SEQ ID NO: 2941 - DNA, 19 bp, Homo sapiens
ttgagcaatttctgcacag

SEQ ID NO: 2942 - DNA, 19 bp, Homo sapiens
ctgatatacatcacggagt

SEQ ID NO: 2943 - DNA, 19 bp, Homo sapiens
acatcacggagttactgaa

SEQ ID NO: 2944 - DNA, 19 bp, Homo sapiens
actgcctatattgataaaa

SEQ ID NO: 2945 - DNA, 19 bp, Homo sapiens
aggatggcattttttgcaa

SEQ ID NO: 2946 - DNA, 19 bp, Homo sapiens
ttttttgcaagttaaagaa

SEQ ID NO: 2947 - DNA, 19 bp, Homo sapiens
tccagaactcaagtcttca

SEQ ID NO: 2948 - DNA, 19 bp, Homo sapiens
agttagtgaaagaagttct

SEQ ID NO: 2949 - DNA, 19 bp, Homo sapiens
atttacagctctgacaagt

SEQ ID NO: 2950 - DNA, 19 bp, Homo sapiens
gattatctgaattcattca

SEQ ID NO: 2951 - DNA, 19 bp, Homo sapiens
gtgcccttctcggttgctg

SEQ ID NO: 2952 - DNA, 19 bp, Homo sapiens
attcaagcacctccggaag

SEQ ID NO: 2953 - DNA, 19 bp, Homo sapiens
gactgctgattcaagaagt

SEQ ID NO: 2954 - DNA, 19 bp, Homo sapiens
ttgctgcagccatgtccag

SEQ ID NO: 2955 - DNA, 19 bp, Homo sapiens
agaaagatgaacctactta

SEQ ID NO: 2956 - DNA, 19 bp, Homo sapiens
tgaagactctccaggaact

SEQ ID NO: 2957 - DNA, 19 bp, Homo sapiens
atctctcttgccacagctg

SEQ ID NO: 2958 - DNA, 19 bp, Homo sapiens
tctctcttgccacagctga

SEQ ID NO: 2959 - DNA, 19 bp, Homo sapiens
tgaggtgtccagccccatc

SEQ ID NO: 2960 - DNA, 19 bp, Homo sapiens
ccagaactcaagtcttcaa

SEQ ID NO: 2961 - DNA, 19 bp, Homo sapiens
ctgaaaaagttagtgaaag

SEQ ID NO: 2962 - DNA, 19 bp, Homo sapiens
tttttcccagacagtgtca

SEQ ID NO: 2963 - DNA, 19 bp, Homo sapiens
ttttcccagacagtgtcaa

SEQ ID NO: 2964 - DNA, 19 bp, Homo sapiens
cattcagaacaagaaaatt

SEQ ID NO: 2965 - DNA, 19 bp, Homo sapiens
tgaagagaagattgaattt

SEQ ID NO: 2966 - DNA, 19 bp, Homo sapiens
tttgaatggaacacaggca

SEQ ID NO: 2967 - DNA, 19 bp, Homo sapiens
ttctagattcgaatatcaa

SEQ ID NO: 2968 - DNA, 19 bp, Homo sapiens
gattcgaatatcaaattca

SEQ ID NO: 2969 - DNA, 19 bp, Homo sapiens
tgcaacgaccaacttgaag

SEQ ID NO: 2970 - DNA, 19 bp, Homo sapiens
ttaagctctcaaatgacat

SEQ ID NO: 2971 - DNA, 19 bp, Homo sapiens
caatttaacaacaatgaat

SEQ ID NO: 2972 - DNA, 19 bp, Homo sapiens
tgaatacagccaggacttg

SEQ ID NO: 2973 - DNA, 19 bp, Homo sapiens
catcaatattgatcaattt

SEQ ID NO: 2974 - DNA, 19 bp, Homo sapiens
ttgagcatgtcaaacactt

SEQ ID NO: 2975 - DNA, 19 bp, Homo sapiens
tgaaggagactattcagaa

SEQ ID NO: 2976 - DNA, 19 bp, Homo sapiens
ttcaggctcttcagaaagc

SEQ ID NO: 2977 - DNA, 19 bp, Homo sapiens
tccacaaattgaacatccc

SEQ ID NO: 2978 - DNA, 19 bp, Homo sapiens
tgaataccaatgctgaact

SEQ ID NO: 2979 - DNA, 19 bp, Homo sapiens
taaactaatagatgtaatc

SEQ ID NO: 2980 - DNA, 19 bp, Homo sapiens
ttgacctgtccattcaaaa

SEQ ID NO: 2981 - DNA, 19 bp, Homo sapiens
gggctgagtgcccttctcg

SEQ ID NO: 2982 - DNA, 19 bp, Homo sapiens
ggctgagtgcccttctcgg

SEQ ID NO: 2983 - DNA, 19 bp, Homo sapiens
ctgagtgcccttctcggtt

SEQ ID NO: 2984 - DNA, 19 bp, Homo sapiens
tctcggttgctgccgctga

SEQ ID NO: 2985 - DNA, 19 bp, Homo sapiens
caggccgcagcccaggagc

SEQ ID NO: 2986 - DNA, 19 bp, Homo sapiens
gctggcgctgcctgcgctg

SEQ ID NO: 2987 - DNA, 19 bp, Homo sapiens
tgctgctggcgggcgccag

SEQ ID NO: 2988 - DNA, 19 bp, Homo sapiens
ctggtctgtccaaaagatg

SEQ ID NO: 2989 - DNA, 19 bp, Homo sapiens
ctgagagttccagtggagt

SEQ ID NO: 2990 - DNA, 19 bp, Homo sapiens
tccagtggagtccctggga

SEQ ID NO: 2991 - DNA, 19 bp, Homo sapiens
aggttgagctggaggttcc

SEQ ID NO: 2992 - DNA, 19 bp, Homo sapiens
tgagctggaggttccccag

SEQ ID NO: 2993 - DNA, 19 bp, Homo sapiens
tctgcagcttcatcctgaa

SEQ ID NO: 2994 - DNA, 19 bp, Homo sapiens
gccagtgcaccctgaaaga

SEQ ID NO: 2995 - DNA, 19 bp, Homo sapiens
ctctgaggagtttgctgca

SEQ ID NO: 2996 - DNA, 19 bp, Homo sapiens
aggtatgagctcaagctgg

SEQ ID NO: 2997 - DNA, 19 bp, Homo sapiens
tcctttacccggagaaaga

SEQ ID NO: 2998 - DNA, 19 bp, Homo sapiens
catcaagaggggcatcatt

SEQ ID NO: 2999 - DNA, 19 bp, Homo sapiens
tcctggttcccccagagac

SEQ ID NO: 3000 - DNA, 19 bp, Homo sapiens
aagaagccaagcaagtgtt

SEQ ID NO: 3001 - DNA, 19 bp, Homo sapiens
aagcaagtgttgtttctgg

SEQ ID NO: 3002 - DNA, 19 bp, Homo sapiens
tctggataccgtgtatgga

SEQ ID NO: 3003 - DNA, 19 bp, Homo sapiens
ccactcactttaccgtcaa

SEQ ID NO: 3004 - DNA, 19 bp, Homo sapiens
aggaagggcaatgtggcaa

SEQ ID NO: 3005 - DNA, 19 bp, Homo sapiens
gcaatgtggcaacagaaat

SEQ ID NO: 3006 - DNA, 19 bp, Homo sapiens
caatgtggcaacagaaata

SEQ ID NO: 3007 - DNA, 19 bp, Homo sapiens
tggcaacagaaatatccac

SEQ ID NO: 3008 - DNA, 19 bp, Homo sapiens
agagacctgggccagtgtg

SEQ ID NO: 3009 - DNA, 19 bp, Homo sapiens
tgtgatcgcttcaagccca

SEQ ID NO: 3010 - DNA, 19 bp, Homo sapiens
gtgatcgcttcaagcccat

SEQ ID NO: 3011 - DNA, 19 bp, Homo sapiens
cagcccacttgctctcatc

SEQ ID NO: 3012 - DNA, 19 bp, Homo sapiens
gctctcatcaaaggcatga

SEQ ID NO: 3013 - DNA, 19 bp, Homo sapiens
ccttgtcaactctgatcag

SEQ ID NO: 3014 - DNA, 19 bp, Homo sapiens
cttgtcaactctgatcagc

SEQ ID NO: 3015 - DNA, 19 bp, Homo sapiens
agccatctgcaaggagcaa

SEQ ID NO: 3016 - DNA, 19 bp, Homo sapiens
gccatctgcaaggagcaac

SEQ ID NO: 3017 - DNA, 19 bp, Homo sapiens
cttcctgcctttctcctac

SEQ ID NO: 3018 - DNA, 19 bp, Homo sapiens
ctttctcctacaagaataa

SEQ ID NO: 3019 - DNA, 19 bp, Homo sapiens
gatcaacagccgcttcttt

SEQ ID NO: 3020 - DNA, 19 bp, Homo sapiens
atcaacagccgcttctttg

SEQ ID NO: 3021 - DNA, 19 bp, Homo sapiens
acagccgcttctttggtga

SEQ ID NO: 3022 - DNA, 19 bp, Homo sapiens
aagatgggcctcgcatttg

SEQ ID NO: 3023 - DNA, 19 bp, Homo sapiens
tgttttgaagactctccag

SEQ ID NO: 3024 - DNA, 19 bp, Homo sapiens
ttgaagactctccaggaac

SEQ ID NO: 3025 - DNA, 19 bp, Homo sapiens
aactgaaaaaactaaccat

SEQ ID NO: 3026 - DNA, 19 bp, Homo sapiens
ctgaaaaaactaaccatct

SEQ ID NO: 3027 - DNA, 19 bp, Homo sapiens
aaaactaaccatctctgag

SEQ ID NO: 3028 - DNA, 19 bp, Homo sapiens
tgagcaaaatatccagaga

SEQ ID NO: 3029 - DNA, 19 bp, Homo sapiens
caataagctggttactgag

SEQ ID NO: 3030 - DNA, 19 bp, Homo sapiens
tactgagctgagaggcctc

SEQ ID NO: 3031 - DNA, 19 bp, Homo sapiens
gcctcagtgatgaagcagt

SEQ ID NO: 3032 - DNA, 19 bp, Homo sapiens
agtcacatctctcttgcca

SEQ ID NO: 3033 - DNA, 19 bp, Homo sapiens
atctctcttgccacagctg

SEQ ID NO: 3034 - DNA, 19 bp, Homo sapiens
tctctcttgccacagctga

SEQ ID NO: 3035 - DNA, 19 bp, Homo sapiens
tgccacagctgattgaggt

SEQ ID NO: 3036 - DNA, 19 bp, Homo sapiens
gccacagctgattgaggtg

SEQ ID NO: 3037 - DNA, 19 bp, Homo sapiens
tcactttacaagccttggt

SEQ ID NO: 3038 - DNA, 19 bp, Homo sapiens
cccttctgatagatgtggt

SEQ ID NO: 3039 - DNA, 19 bp, Homo sapiens
gtcacctacctggtggccc

SEQ ID NO: 3040 - DNA, 19 bp, Homo sapiens
ccttgtatgcgctgagcca

SEQ ID NO: 3041 - DNA, 19 bp, Homo sapiens
gacaaaccctacagggacc

SEQ ID NO: 3042 - DNA, 19 bp, Homo sapiens
tgctaattacctgatggaa

SEQ ID NO: 3043 - DNA, 19 bp, Homo sapiens
tgactgcactggggatgaa

SEQ ID NO: 3044 - DNA, 19 bp, Homo sapiens
actgcactggggatgaaga

SEQ ID NO: 3045 - DNA, 19 bp, Homo sapiens
atgaagattacacctattt

SEQ ID NO: 3046 - DNA, 19 bp, Homo sapiens
accatggagcagttaactc

SEQ ID NO: 3047 - DNA, 19 bp, Homo sapiens
gcagttaactccagaactc

SEQ ID NO: 3048 - DNA, 19 bp, Homo sapiens
cagaactcaagtcttcaat

SEQ ID NO: 3049 - DNA, 19 bp, Homo sapiens
caggctctgcggaaaatgg

SEQ ID NO: 3050 - DNA, 19 bp, Homo sapiens
ccaggaggttcttcttcag

SEQ ID NO: 3051 - DNA, 19 bp, Homo sapiens
ggttcttcttcagactttc

SEQ ID NO: 3052 - DNA, 19 bp, Homo sapiens
tttccttgatgatgcttct

SEQ ID NO: 3053 - DNA, 19 bp, Homo sapiens
ggagataagcgactggctg

SEQ ID NO: 3054 - DNA, 19 bp, Homo sapiens
gctgcctatcttatgttga

SEQ ID NO: 3055 - DNA, 19 bp, Homo sapiens
actttgtggcttcccatat

SEQ ID NO: 3056 - DNA, 19 bp, Homo sapiens
gccaatatcttgaactcag

SEQ ID NO: 3057 - DNA, 19 bp, Homo sapiens
aatatcttgaactcagaag

SEQ ID NO: 3058 - DNA, 19 bp, Homo sapiens
ctcagaagaattggatatc

SEQ ID NO: 3059 - DNA, 19 bp, Homo sapiens
aagaattggatatccaaga

SEQ ID NO: 3060 - DNA, 19 bp, Homo sapiens
agaattggatatccaagat

SEQ ID NO: 3061 - DNA, 19 bp, Homo sapiens
tggatatccaagatctgaa

SEQ ID NO: 3062 - DNA, 19 bp, Homo sapiens
atatccaagatctgaaaaa

SEQ ID NO: 3063 - DNA, 19 bp, Homo sapiens
tatccaagatctgaaaaag

SEQ ID NO: 3064 - DNA, 19 bp, Homo sapiens
caagatctgaaaaagttag

SEQ ID NO: 3065 - DNA, 19 bp, Homo sapiens
aagatctgaaaaagttagt

SEQ ID NO: 3066 - DNA, 19 bp, Homo sapiens
tgaaaaagttagtgaaaga

SEQ ID NO: 3067 - DNA, 19 bp, Homo sapiens
tccaactgtcatggacttc

SEQ ID NO: 3068 - DNA, 19 bp, Homo sapiens
tcagaaaattctctcggaa

SEQ ID NO: 3069 - DNA, 19 bp, Homo sapiens
ttccatcacttgacccagc

SEQ ID NO: 3070 - DNA, 19 bp, Homo sapiens
cccagcctcagccaaaata

SEQ ID NO: 3071 - DNA, 19 bp, Homo sapiens
agcctcagccaaaatagaa

SEQ ID NO: 3072 - DNA, 19 bp, Homo sapiens
atcttatatttgatccaaa

SEQ ID NO: 3073 - DNA, 19 bp, Homo sapiens
tcttatatttgatccaaat

SEQ ID NO: 3074 - DNA, 19 bp, Homo sapiens
cttcctaaagaaagcatgc

SEQ ID NO: 3075 - DNA, 19 bp, Homo sapiens
ctaaagaaagcatgctgaa

SEQ ID NO: 3076 - DNA, 19 bp, Homo sapiens
taaagaaagcatgctgaaa

SEQ ID NO: 3077 - DNA, 19 bp, Homo sapiens
gagattggcttggaaggaa

SEQ ID NO: 3078 - DNA, 19 bp, Homo sapiens
ctttgagccaacattggaa

SEQ ID NO: 3079 - DNA, 19 bp, Homo sapiens
cagacagtgtcaacaaagc

SEQ ID NO: 3080 - DNA, 19 bp, Homo sapiens
cagtgtcaacaaagctttg

SEQ ID NO: 3081 - DNA, 19 bp, Homo sapiens
agtgtcaacaaagctttgt

SEQ ID NO: 3082 - DNA, 19 bp, Homo sapiens
ctgatggtgtctctaaggt

SEQ ID NO: 3083 - DNA, 19 bp, Homo sapiens
tgatggtgtctctaaggtc

SEQ ID NO: 3084 - DNA, 19 bp, Homo sapiens
aaacatgagcaggatatgg

SEQ ID NO: 3085 - DNA, 19 bp, Homo sapiens
gaagctgattaaagatttg

SEQ ID NO: 3086 - DNA, 19 bp, Homo sapiens
aaagatttgaaatccaaag

SEQ ID NO: 3087 - DNA, 19 bp, Homo sapiens
gatgggtgcccgcactctg

SEQ ID NO: 3088 - DNA, 19 bp, Homo sapiens
gggatcccccagatgattg

SEQ ID NO: 3089 - DNA, 19 bp, Homo sapiens
ttttcttcactacatcttc

SEQ ID NO: 3090 - DNA, 19 bp, Homo sapiens
tcttcactacatcttcatg

SEQ ID NO: 3091 - DNA, 19 bp, Homo sapiens
tacatcttcatggagaatg

SEQ ID NO: 3092 - DNA, 19 bp, Homo sapiens
ttcatggagaatgcctttg

SEQ ID NO: 3093 - DNA, 19 bp, Homo sapiens
tcatggagaatgcctttga

SEQ ID NO: 3094 - DNA, 19 bp, Homo sapiens
tttgaactccccactggag

SEQ ID NO: 3095 - DNA, 19 bp, Homo sapiens
ttgaactccccactggagc

SEQ ID NO: 3096 - DNA, 19 bp, Homo sapiens
tgaactccccactggagct

SEQ ID NO: 3097 - DNA, 19 bp, Homo sapiens
cactggagctggattacag

SEQ ID NO: 3098 - DNA, 19 bp, Homo sapiens
actggagctggattacagt

SEQ ID NO: 3099 - DNA, 19 bp, Homo sapiens
agttgcaaatatcttcatc

SEQ ID NO: 3100 - DNA, 19 bp, Homo sapiens
gttgcaaatatcttcatct

SEQ ID NO: 3101 - DNA, 19 bp, Homo sapiens
aaatatcttcatctggagt

SEQ ID NO: 3102 - DNA, 19 bp, Homo sapiens
taaaactggaagtagccaa

SEQ ID NO: 3103 - DNA, 19 bp, Homo sapiens
ggctgaactggtggcaaaa

SEQ ID NO: 3104 - DNA, 19 bp, Homo sapiens
tgtggagtttgtgacaaat

SEQ ID NO: 3105 - DNA, 19 bp, Homo sapiens
ttgtgacaaatatgggcat

SEQ ID NO: 3106 - DNA, 19 bp, Homo sapiens
atgaacaccaacttcttcc

SEQ ID NO: 3107 - DNA, 19 bp, Homo sapiens
cttccacgagtcgggtctg

SEQ ID NO: 3108 - DNA, 19 bp, Homo sapiens
gagtcgggtctggaggctc

SEQ ID NO: 3109 - DNA, 19 bp, Homo sapiens
cctaaaagctgggaagctg

SEQ ID NO: 3110 - DNA, 19 bp, Homo sapiens
agctgggaagctgaagttt

SEQ ID NO: 3111 - DNA, 19 bp, Homo sapiens
ccagattagagctggaact

SEQ ID NO: 3112 - DNA, 19 bp, Homo sapiens
ggataccctgaagtttgta

SEQ ID NO: 3113 - DNA, 19 bp, Homo sapiens
ctgaggctaccatgacatt

SEQ ID NO: 3114 - DNA, 19 bp, Homo sapiens
tgtccagtgaagtccaaat

SEQ ID NO: 3115 - DNA, 19 bp, Homo sapiens
aattccggattttgatgtt

SEQ ID NO: 3116 - DNA, 19 bp, Homo sapiens
ttccggattttgatgttga

SEQ ID NO: 3117 - DNA, 19 bp, Homo sapiens
cggaacaatcctcagagtt

SEQ ID NO: 3118 - DNA, 19 bp, Homo sapiens
tcctcagagttaatgatga

SEQ ID NO: 3119 - DNA, 19 bp, Homo sapiens
ctcaccctggacattcaga

SEQ ID NO: 3120 - DNA, 19 bp, Homo sapiens
cattcagaacaagaaaatt

SEQ ID NO: 3121 - DNA, 19 bp, Homo sapiens
actgaggtcgccctcatgg

SEQ ID NO: 3122 - DNA, 19 bp, Homo sapiens
ttatttccataccccgttt

SEQ ID NO: 3123 - DNA, 19 bp, Homo sapiens
gtttgcaagcagaagccag

SEQ ID NO: 3124 - DNA, 19 bp, Homo sapiens
tttgcaagcagaagccaga

SEQ ID NO: 3125 - DNA, 19 bp, Homo sapiens
ttgcaagcagaagccagaa

SEQ ID NO: 3126 - DNA, 19 bp, Homo sapiens
ctgcttctccaaatggact

SEQ ID NO: 3127 - DNA, 19 bp, Homo sapiens
tgctacagcttatggctcc

SEQ ID NO: 3128 - DNA, 19 bp, Homo sapiens
acagcttatggctccacag

SEQ ID NO: 3129 - DNA, 19 bp, Homo sapiens
tttccaagagggtggcatg

SEQ ID NO: 3130 - DNA, 19 bp, Homo sapiens
ccaagagggtggcatggca

SEQ ID NO: 3131 - DNA, 19 bp, Homo sapiens
gtggcatggcattatgatg

SEQ ID NO: 3132 - DNA, 19 bp, Homo sapiens
tgatgaagagaagattgaa

SEQ ID NO: 3133 - DNA, 19 bp, Homo sapiens
gaagagaagattgaatttg

SEQ ID NO: 3134 - DNA, 19 bp, Homo sapiens
gagaagattgaatttgaat

SEQ ID NO: 3135 - DNA, 19 bp, Homo sapiens
tttgaatggaacacaggca

SEQ ID NO: 3136 - DNA, 19 bp, Homo sapiens
aggcaccaatgtagatacc

SEQ ID NO: 3137 - DNA, 19 bp, Homo sapiens
caaaaaaatgacttccaat

SEQ ID NO: 3138 - DNA, 19 bp, Homo sapiens
aaaaaaatgacttccaatt

SEQ ID NO: 3139 - DNA, 19 bp, Homo sapiens
aaaaaatgacttccaattt

SEQ ID NO: 3140 - DNA, 19 bp, Homo sapiens
cagagtccctcaaacagac

SEQ ID NO: 3141 - DNA, 19 bp, Homo sapiens
aaattaatagttgcaatga

SEQ ID NO: 3142 - DNA, 19 bp, Homo sapiens
ttcaacctccagaacatgg

SEQ ID NO: 3143 - DNA, 19 bp, Homo sapiens
tgggattgccagacttcca

SEQ ID NO: 3144 - DNA, 19 bp, Homo sapiens
cagtttgaaaattgagatt

SEQ ID NO: 3145 - DNA, 19 bp, Homo sapiens
gaaaattgagattcctttg

SEQ ID NO: 3146 - DNA, 19 bp, Homo sapiens
tttgccttttggtggcaaa

SEQ ID NO: 3147 - DNA, 19 bp, Homo sapiens
ctccagagatctaaagatg

SEQ ID NO: 3148 - DNA, 19 bp, Homo sapiens
tctaaagatgttagagact

SEQ ID NO: 3149 - DNA, 19 bp, Homo sapiens
ctgtgggattccatctgcc

SEQ ID NO: 3150 - DNA, 19 bp, Homo sapiens
atctgccatctcgagagtt

SEQ ID NO: 3151 - DNA, 19 bp, Homo sapiens
tctcgagagttccaagtcc

SEQ ID NO: 3152 - DNA, 19 bp, Homo sapiens
agtccctacttttaccatt

SEQ ID NO: 3153 - DNA, 19 bp, Homo sapiens
acttttaccattcccaagt

SEQ ID NO: 3154 - DNA, 19 bp, Homo sapiens
cattcccaagttgtatcaa

SEQ ID NO: 3155 - DNA, 19 bp, Homo sapiens
accacatgaaggctgactc

SEQ ID NO: 3156 - DNA, 19 bp, Homo sapiens
tttcctacaatgtgcaagg

SEQ ID NO: 3157 - DNA, 19 bp, Homo sapiens
ctggagaaacaacatatga

SEQ ID NO: 3158 - DNA, 19 bp, Homo sapiens
atcatgtgatgggtctcta

SEQ ID NO: 3159 - DNA, 19 bp, Homo sapiens
catgtgatgggtctctacg

SEQ ID NO: 3160 - DNA, 19 bp, Homo sapiens
ttctagattcgaatatcaa

SEQ ID NO: 3161 - DNA, 19 bp, Homo sapiens
tggggaccacagatgtctg

SEQ ID NO: 3162 - DNA, 19 bp, Homo sapiens
ctaacactggccggctcaa

SEQ ID NO: 3163 - DNA, 19 bp, Homo sapiens
taacactggccggctcaat

SEQ ID NO: 3164 - DNA, 19 bp, Homo sapiens
aacactggccggctcaatg

SEQ ID NO: 3165 - DNA, 19 bp, Homo sapiens
ctggccggctcaatggaga

SEQ ID NO: 3166 - DNA, 19 bp, Homo sapiens
agataacaggaagatatga

SEQ ID NO: 3167 - DNA, 19 bp, Homo sapiens
tccctcacctccacctctg

SEQ ID NO: 3168 - DNA, 19 bp, Homo sapiens
agctgactttaaaatctga

SEQ ID NO: 3169 - DNA, 19 bp, Homo sapiens
ctgactttaaaatctgaca

SEQ ID NO: 3170 - DNA, 19 bp, Homo sapiens
caagatggatatgaccttc

SEQ ID NO: 3171 - DNA, 19 bp, Homo sapiens
gctgcgttctgaatatcag

SEQ ID NO: 3172 - DNA, 19 bp, Homo sapiens
cgttctgaatatcaggctg

SEQ ID NO: 3173 - DNA, 19 bp, Homo sapiens
aattcccatggtcttgagt

SEQ ID NO: 3174 - DNA, 19 bp, Homo sapiens
tggtcttgagttaaatgct

SEQ ID NO: 3175 - DNA, 19 bp, Homo sapiens
cttgagttaaatgctgaca

SEQ ID NO: 3176 - DNA, 19 bp, Homo sapiens
ttgagttaaatgctgacat

SEQ ID NO: 3177 - DNA, 19 bp, Homo sapiens
tgagttaaatgctgacatc

SEQ ID NO: 3178 - DNA, 19 bp, Homo sapiens
acttgaagtgtagtctcct

SEQ ID NO: 3179 - DNA, 19 bp, Homo sapiens
agtgtagtctcctggtgct

SEQ ID NO: 3180 - DNA, 19 bp, Homo sapiens
gtgctggagaatgagctga

SEQ ID NO: 3181 - DNA, 19 bp, Homo sapiens
ctggggcatctatgaaatt

SEQ ID NO: 3182 - DNA, 19 bp, Homo sapiens
atggccgcttcagggaaca

SEQ ID NO: 3183 - DNA, 19 bp, Homo sapiens
ttcagtctggatgggaaag

SEQ ID NO: 3184 - DNA, 19 bp, Homo sapiens
ccatgattctgggtgtcga

SEQ ID NO: 3185 - DNA, 19 bp, Homo sapiens
aaaacattttcaacttcaa

SEQ ID NO: 3186 - DNA, 19 bp, Homo sapiens
cttaagctctcaaatgaca

SEQ ID NO: 3187 - DNA, 19 bp, Homo sapiens
ttaagctctcaaatgacat

SEQ ID NO: 3188 - DNA, 19 bp, Homo sapiens
catgatgggctcatatgct

SEQ ID NO: 3189 - DNA, 19 bp, Homo sapiens
tgggctcatatgctgaaat

SEQ ID NO: 3190 - DNA, 19 bp, Homo sapiens
actggacttctcttcaaaa

SEQ ID NO: 3191 - DNA, 19 bp, Homo sapiens
acttctcttcaaaacttga

SEQ ID NO: 3192 - DNA, 19 bp, Homo sapiens
ctgacaagttttataagca

SEQ ID NO: 3193 - DNA, 19 bp, Homo sapiens
aagttttataagcaaactg

SEQ ID NO: 3194 - DNA, 19 bp, Homo sapiens
ctgttaatttacagctaca

SEQ ID NO: 3195 - DNA, 19 bp, Homo sapiens
ttacagctacagccctatt

SEQ ID NO: 3196 - DNA, 19 bp, Homo sapiens
tctggtaactactttaaac

SEQ ID NO: 3197 - DNA, 19 bp, Homo sapiens
tttaaacagtgacctgaaa

SEQ ID NO: 3198 - DNA, 19 bp, Homo sapiens
ttaaacagtgacctgaaat

SEQ ID NO: 3199 - DNA, 19 bp, Homo sapiens
cagtgacctgaaatacaat

SEQ ID NO: 3200 - DNA, 19 bp, Homo sapiens
tgtggctggtaacctaaaa

SEQ ID NO: 3201 - DNA, 19 bp, Homo sapiens
ttatcagcaagctataaag

SEQ ID NO: 3202 - DNA, 19 bp, Homo sapiens
ggttcagggtgtggagttt

SEQ ID NO: 3203 - DNA, 19 bp, Homo sapiens
attcagactcactgcattt

SEQ ID NO: 3204 - DNA, 19 bp, Homo sapiens
ttcagactcactgcatttc

SEQ ID NO: 3205 - DNA, 19 bp, Homo sapiens
tacaaatggcaatgggaaa

SEQ ID NO: 3206 - DNA, 19 bp, Homo sapiens
gctgtatagcaaattcctg

SEQ ID NO: 3207 - DNA, 19 bp, Homo sapiens
tgagcagacaggcacctgg

SEQ ID NO: 3208 - DNA, 19 bp, Homo sapiens
ggcacctggaaactcaaga

SEQ ID NO: 3209 - DNA, 19 bp, Homo sapiens
tgaatacagccaggacttg

SEQ ID NO: 3210 - DNA, 19 bp, Homo sapiens
gaatacagccaggacttgg

SEQ ID NO: 3211 - DNA, 19 bp, Homo sapiens
ctggacgaactctggctga

SEQ ID NO: 3212 - DNA, 19 bp, Homo sapiens
ttttactcagtgagcccat

SEQ ID NO: 3213 - DNA, 19 bp, Homo sapiens
gatgagagatgccgttgag

SEQ ID NO: 3214 - DNA, 19 bp, Homo sapiens
aattgttgcttttgtaaag

SEQ ID NO: 3215 - DNA, 19 bp, Homo sapiens
cttttgtaaagtatgataa

SEQ ID NO: 3216 - DNA, 19 bp, Homo sapiens
tttgtaaagtatgataaaa

SEQ ID NO: 3217 - DNA, 19 bp, Homo sapiens
tccattaacctcccatttt

SEQ ID NO: 3218 - DNA, 19 bp, Homo sapiens
ccattaacctcccattttt

SEQ ID NO: 3219 - DNA, 19 bp, Homo sapiens
cttgcaagaatattttgag

SEQ ID NO: 3220 - DNA, 19 bp, Homo sapiens
agaatattttgagaggaat

SEQ ID NO: 3221 - DNA, 19 bp, Homo sapiens
attatagttgtactggaaa

SEQ ID NO: 3222 - DNA, 19 bp, Homo sapiens
gaagcacatcaatattgat

SEQ ID NO: 3223 - DNA, 19 bp, Homo sapiens
acatcaatattgatcaatt

SEQ ID NO: 3224 - DNA, 19 bp, Homo sapiens
gaaaactcccacagcaagc

SEQ ID NO: 3225 - DNA, 19 bp, Homo sapiens
ctgaattcattcaattggg

SEQ ID NO: 3226 - DNA, 19 bp, Homo sapiens
tgaattcattcaattggga

SEQ ID NO: 3227 - DNA, 19 bp, Homo sapiens
aactgactgctctcacaaa

SEQ ID NO: 3228 - DNA, 19 bp, Homo sapiens
aaaagtatagaattacaga

SEQ ID NO: 3229 - DNA, 19 bp, Homo sapiens
atcaactttaatgaaaaac

SEQ ID NO: 3230 - DNA, 19 bp, Homo sapiens
tgatttgaaaatagctatt

SEQ ID NO: 3231 - DNA, 19 bp, Homo sapiens
atttgaaaatagctattgc

SEQ ID NO: 3232 - DNA, 19 bp, Homo sapiens
attgctaatattattgatg

SEQ ID NO: 3233 - DNA, 19 bp, Homo sapiens
gaaaaattaaaaagtcttg

SEQ ID NO: 3234 - DNA, 19 bp, Homo sapiens
actatcatatccgtgtaat

SEQ ID NO: 3235 - DNA, 19 bp, Homo sapiens
tattgattttaacaaaagt

SEQ ID NO: 3236 - DNA, 19 bp, Homo sapiens
ctgcagcagcttaagagac

SEQ ID NO: 3237 - DNA, 19 bp, Homo sapiens
aaaacaacacattgaggct

SEQ ID NO: 3238 - DNA, 19 bp, Homo sapiens
ttgagcatgtcaaacactt

SEQ ID NO: 3239 - DNA, 19 bp, Homo sapiens
tttgaagtagctgagaaaa

SEQ ID NO: 3240 - DNA, 19 bp, Homo sapiens
ttagtagagttggcccacc

SEQ ID NO: 3241 - DNA, 19 bp, Homo sapiens
tgaaggagactattcagaa

SEQ ID NO: 3242 - DNA, 19 bp, Homo sapiens
gagactattcagaagctaa

SEQ ID NO: 3243 - DNA, 19 bp, Homo sapiens
aattagttggatttattga

SEQ ID NO: 3244 - DNA, 19 bp, Homo sapiens
gcttaatgaattatctttt

SEQ ID NO: 3245 - DNA, 19 bp, Homo sapiens
ttaacaaattccttgacat

SEQ ID NO: 3246 - DNA, 19 bp, Homo sapiens
aaattaaagtcatttgatt

SEQ ID NO: 3247 - DNA, 19 bp, Homo sapiens
gactcaatggtgaaattca

SEQ ID NO: 3248 - DNA, 19 bp, Homo sapiens
gaaattcaggctctggaac

SEQ ID NO: 3249 - DNA, 19 bp, Homo sapiens
actaccacaaaaagctgaa

SEQ ID NO: 3250 - DNA, 19 bp, Homo sapiens
ccaaaataaccttaatcat

SEQ ID NO: 3251 - DNA, 19 bp, Homo sapiens
aaataaccttaatcatcaa

SEQ ID NO: 3252 - DNA, 19 bp, Homo sapiens
tttaagttcagcatctttg

SEQ ID NO: 3253 - DNA, 19 bp, Homo sapiens
caggtttatagcacacttg

SEQ ID NO: 3254 - DNA, 19 bp, Homo sapiens
gttcactgttcctgaaatc

SEQ ID NO: 3255 - DNA, 19 bp, Homo sapiens
cactgttcctgaaatcaag

SEQ ID NO: 3256 - DNA, 19 bp, Homo sapiens
actgttcctgaaatcaaga

SEQ ID NO: 3257 - DNA, 19 bp, Homo sapiens
gcctgcctttgaagtcagt

SEQ ID NO: 3258 - DNA, 19 bp, Homo sapiens
taacagatttgaggattcc

SEQ ID NO: 3259 - DNA, 19 bp, Homo sapiens
gttttccacaccagaattt

SEQ ID NO: 3260 - DNA, 19 bp, Homo sapiens
tcagaaccattgaccagat

SEQ ID NO: 3261 - DNA, 19 bp, Homo sapiens
tagcgagaatcaccctgcc

SEQ ID NO: 3262 - DNA, 19 bp, Homo sapiens
ccttaatgattttcaagtt

SEQ ID NO: 3263 - DNA, 19 bp, Homo sapiens
acataccagaattccagct

SEQ ID NO: 3264 - DNA, 19 bp, Homo sapiens
aatgctgacatagggaatg

SEQ ID NO: 3265 - DNA, 19 bp, Homo sapiens
atgctgacatagggaatgg

SEQ ID NO: 3266 - DNA, 19 bp, Homo sapiens
aaccacctcagcaaacgaa

SEQ ID NO: 3267 - DNA, 19 bp, Homo sapiens
agcaggtatcgcagcttcc

SEQ ID NO: 3268 - DNA, 19 bp, Homo sapiens
tgcacaactctcaaaccct

SEQ ID NO: 3269 - DNA, 19 bp, Homo sapiens
aggagtcagtgaagttctc

SEQ ID NO: 3270 - DNA, 19 bp, Homo sapiens
tttttggaaatgccattga

SEQ ID NO: 3271 - DNA, 19 bp, Homo sapiens
aatggagtgattgtcaaga

SEQ ID NO: 3272 - DNA, 19 bp, Homo sapiens
gtcaagataaacaatcagc

SEQ ID NO: 3273 - DNA, 19 bp, Homo sapiens
tccacaaattgaacatccc

SEQ ID NO: 3274 - DNA, 19 bp, Homo sapiens
ttgaacatccccaaactgg

SEQ ID NO: 3275 - DNA, 19 bp, Homo sapiens
acatccccaaactggactt

SEQ ID NO: 3276 - DNA, 19 bp, Homo sapiens
acttctctagtcaggctga

SEQ ID NO: 3277 - DNA, 19 bp, Homo sapiens
tgaatcacaaattagtttc

SEQ ID NO: 3278 - DNA, 19 bp, Homo sapiens
agaaggacccctcacttcc

SEQ ID NO: 3279 - DNA, 19 bp, Homo sapiens
ttggactgtccaataagat

SEQ ID NO: 3280 - DNA, 19 bp, Homo sapiens
actgtccaataagatcaat

SEQ ID NO: 3281 - DNA, 19 bp, Homo sapiens
ctgtccaataagatcaata

SEQ ID NO: 3282 - DNA, 19 bp, Homo sapiens
gtttatgaatctggctccc

SEQ ID NO: 3283 - DNA, 19 bp, Homo sapiens
atgaatctggctccctcaa

SEQ ID NO: 3284 - DNA, 19 bp, Homo sapiens
ctcaacttttctaaacttg

SEQ ID NO: 3285 - DNA, 19 bp, Homo sapiens
ctaaaggcatggcactgtt

SEQ ID NO: 3286 - DNA, 19 bp, Homo sapiens
aaggcatggcactgtttgg

SEQ ID NO: 3287 - DNA, 19 bp, Homo sapiens
atccacaaacaatgaaggg

SEQ ID NO: 3288 - DNA, 19 bp, Homo sapiens
ggaatttgaaagttcgttt

SEQ ID NO: 3289 - DNA, 19 bp, Homo sapiens
aataactatgcactgtttc

SEQ ID NO: 3290 - DNA, 19 bp, Homo sapiens
gaaacaacgagaacattat

SEQ ID NO: 3291 - DNA, 19 bp, Homo sapiens
ttcttgaaaacgacaaagc

SEQ ID NO: 3292 - DNA, 19 bp, Homo sapiens
ataagaaaaacaaacacag

SEQ ID NO: 3293 - DNA, 19 bp, Homo sapiens
aaaacaaacacaggcattc

SEQ ID NO: 3294 - DNA, 19 bp, Homo sapiens
gcattccatcacaaatcct

SEQ ID NO: 3295 - DNA, 19 bp, Homo sapiens
tttgaaaaaaacagaaaca

SEQ ID NO: 3296 - DNA, 19 bp, Homo sapiens
caatgcattagattttgtc

SEQ ID NO: 3297 - DNA, 19 bp, Homo sapiens
caaagctgaaaaatctcag

SEQ ID NO: 3298 - DNA, 19 bp, Homo sapiens
cctggatacactgttccag

SEQ ID NO: 3299 - DNA, 19 bp, Homo sapiens
gttgaagtgtctccattca

SEQ ID NO: 3300 - DNA, 19 bp, Homo sapiens
tttctccatcctaggttct

SEQ ID NO: 3301 - DNA, 19 bp, Homo sapiens
ttctccatcctaggttctg

SEQ ID NO: 3302 - DNA, 19 bp, Homo sapiens
tcattagagctgccagtcc

SEQ ID NO: 3303 - DNA, 19 bp, Homo sapiens
tgctgaactttttaaccag

SEQ ID NO: 3304 - DNA, 19 bp, Homo sapiens
ctcctttcttcatcttcat

SEQ ID NO: 3305 - DNA, 19 bp, Homo sapiens
tgtcattgatgcactgcag

SEQ ID NO: 3306 - DNA, 19 bp, Homo sapiens
tgatgcactgcagtacaaa

SEQ ID NO: 3307 - DNA, 19 bp, Homo sapiens
agctctgtctctgagcaac

SEQ ID NO: 3308 - DNA, 19 bp, Homo sapiens
agccgaaattccaattttg

SEQ ID NO: 3309 - DNA, 19 bp, Homo sapiens
ttgagaatgaatttcaagc

SEQ ID NO: 3310 - DNA, 19 bp, Homo sapiens
aaacctactgtctcttcct

SEQ ID NO: 3311 - DNA, 19 bp, Homo sapiens
tacttttccattgagtcat

SEQ ID NO: 3312 - DNA, 19 bp, Homo sapiens
tcaggtccatgcaagtcag

SEQ ID NO: 3313 - DNA, 19 bp, Homo sapiens
atgcaagtcagcccagttc

SEQ ID NO: 3314 - DNA, 19 bp, Homo sapiens
tgaatgctaacactaagaa

SEQ ID NO: 3315 - DNA, 19 bp, Homo sapiens
agaagatcagatggaaaaa

SEQ ID NO: 3316 - DNA, 19 bp, Homo sapiens
ggctattcattctccatcc

SEQ ID NO: 3317 - DNA, 19 bp, Homo sapiens
aaagttttggctgataaat

SEQ ID NO: 3318 - DNA, 19 bp, Homo sapiens
agttttggctgataaattc

SEQ ID NO: 3319 - DNA, 19 bp, Homo sapiens
ctgggctgaaactaaatga

SEQ ID NO: 3320 - DNA, 19 bp, Homo sapiens
cagagaaatacaaatctat

SEQ ID NO: 3321 - DNA, 19 bp, Homo sapiens
gaggtaaaattccctgaag

SEQ ID NO: 3322 - DNA, 19 bp, Homo sapiens
cttttttgagataaccgtg

SEQ ID NO: 3323 - DNA, 19 bp, Homo sapiens
gctggaattgtcattcctt

SEQ ID NO: 3324 - DNA, 19 bp, Homo sapiens
gtgtataatgccacttgga

SEQ ID NO: 3325 - DNA, 19 bp, Homo sapiens
attccacatgcagctcaac

SEQ ID NO: 3326 - DNA, 19 bp, Homo sapiens
tgaagaagatggcaaattt

SEQ ID NO: 3327 - DNA, 19 bp, Homo sapiens
atcaaaagcccagcgttca

SEQ ID NO: 3328 - DNA, 19 bp, Homo sapiens
gtgggcatggatatggatg

SEQ ID NO: 3329 - DNA, 19 bp, Homo sapiens
aaatggaacttctactaca

SEQ ID NO: 3330 - DNA, 19 bp, Homo sapiens
aaaaactcaccatattcaa

SEQ ID NO: 3331 - DNA, 19 bp, Homo sapiens
ctgagaagaaatctgcaga

SEQ ID NO: 3332 - DNA, 19 bp, Homo sapiens
acaatgctgagtgggttta

SEQ ID NO: 3333 - DNA, 19 bp, Homo sapiens
caatgctgagtgggtttat

SEQ ID NO: 3334 - DNA, 19 bp, Homo sapiens
ttaggcaaattgatgatat

SEQ ID NO: 3335 - DNA, 19 bp, Homo sapiens
ataaactaatagatgtaat

SEQ ID NO: 3336 - DNA, 19 bp, Homo sapiens
ccaactaatagaagataac

SEQ ID NO: 3337 - DNA, 19 bp, Homo sapiens
ttaattatatccaagatga

SEQ ID NO: 3338 - DNA, 19 bp, Homo sapiens
tttaaattgttgaaagaaa

SEQ ID NO: 3339 - DNA, 19 bp, Homo sapiens
aagttcaatgaatttattc

SEQ ID NO: 3340 - DNA, 19 bp, Homo sapiens
ttgaagaaaagatagtcag

SEQ ID NO: 3341 - DNA, 19 bp, Homo sapiens
acttccattctgaatatat

SEQ ID NO: 3342 - DNA, 19 bp, Homo sapiens
cacagaaatattcaggaat

SEQ ID NO: 3343 - DNA, 19 bp, Homo sapiens
ccattgcgacgaagaaaat

SEQ ID NO: 3344 - DNA, 19 bp, Homo sapiens
tataaactgcaagattttt

SEQ ID NO: 3345 - DNA, 19 bp, Homo sapiens
tctgattactatgaaaaat

SEQ ID NO: 3346 - DNA, 19 bp, Homo sapiens
ggagttactgaaaaagctg

SEQ ID NO: 3347 - DNA, 19 bp, Homo sapiens
tgaagcttgctccaggaga

SEQ ID NO: 3348 - DNA, 19 bp, Homo sapiens
tgaactggacctgcaccaa

SEQ ID NO: 3349 - DNA, 19 bp, Homo sapiens
ttgctaaacttgggggagg

SEQ ID NO: 3350 - DNA, 19 bp, Homo sapiens
gattcgaatatcaaattca

SEQ ID NO: 3351 - DNA, 19 bp, Homo sapiens
atttgtttgtcaaagaagt

SEQ ID NO: 3352 - DNA, 19 bp, Homo sapiens
tctcggttgctgccgctga

SEQ ID NO: 3353 - DNA, 19 bp, Homo sapiens
gctgaggagcccgcccagc

SEQ ID NO: 3354 - DNA, 19 bp, Homo sapiens
ctggtctgtccaaaagatg

SEQ ID NO: 3355 - DNA, 19 bp, Homo sapiens
ctgagagttccagtggagt

SEQ ID NO: 3356 - DNA, 19 bp, Homo sapiens
cagtgcaccctgaaagagg

SEQ ID NO: 3357 - DNA, 19 bp, Homo sapiens
ctctgaggagtttgctgca

SEQ ID NO: 3358 - DNA, 19 bp, Homo sapiens
acatcaagaggggcatcat

SEQ ID NO: 3359 - DNA, 19 bp, Homo sapiens
ctgatcagcagcagccagt

SEQ ID NO: 3360 - DNA, 19 bp, Homo sapiens
ggacgctaagaggaagcat

SEQ ID NO: 3361 - DNA, 19 bp, Homo sapiens
agctgttttgaagactctc

SEQ ID NO: 3362 - DNA, 19 bp, Homo sapiens
tgaaaaaactaaccatctc

SEQ ID NO: 3363 - DNA, 19 bp, Homo sapiens
ctgagctgagaggcctcag

SEQ ID NO: 3364 - DNA, 19 bp, Homo sapiens
tgaaacgtgtgcatgccaa

SEQ ID NO: 3365 - DNA, 19 bp, Homo sapiens
ccttgtatgcgctgagcca

SEQ ID NO: 3366 - DNA, 19 bp, Homo sapiens
aggagctgctggacattgc

SEQ ID NO: 3367 - DNA, 19 bp, Homo sapiens
atttgattctgcgggtcat

SEQ ID NO: 3368 - DNA, 19 bp, Homo sapiens
tccagaactcaagtcttca

SEQ ID NO: 3369 - DNA, 19 bp, Homo sapiens
ggttcttcttcagactttc

SEQ ID NO: 3370 - DNA, 19 bp, Homo sapiens
gttgatgaggagtccttca

SEQ ID NO: 3371 - DNA, 19 bp, Homo sapiens
tccaagatctgaaaaagtt

SEQ ID NO: 3372 - DNA, 19 bp, Homo sapiens
agttagtgaaagaagttct

SEQ ID NO: 3373 - DNA, 19 bp, Homo sapiens
gaagggaatcttatatttg

SEQ ID NO: 3374 - DNA, 19 bp, Homo sapiens
ggaagctctttttgggaag

SEQ ID NO: 3375 - DNA, 19 bp, Homo sapiens
tggaataatgctcagtgtt

SEQ ID NO: 3376 - DNA, 19 bp, Homo sapiens
gatttgaaatccaaagaag

SEQ ID NO: 3377 - DNA, 19 bp, Homo sapiens
tccaaagaagtcccggaag

SEQ ID NO: 3378 - DNA, 19 bp, Homo sapiens
aggaagggctcaaagaatg

SEQ ID NO: 3379 - DNA, 19 bp, Homo sapiens
agaatgacttttttcttca

SEQ ID NO: 3380 - DNA, 19 bp, Homo sapiens
tttgtgacaaatatgggca

SEQ ID NO: 3381 - DNA, 19 bp, Homo sapiens
ctgaggctaccatgacatt

SEQ ID NO: 3382 - DNA, 19 bp, Homo sapiens
gtagataccaaaaaaatga

SEQ ID NO: 3383 - DNA, 19 bp, Homo sapiens
aaatgacttccaatttccc

SEQ ID NO: 3384 - DNA, 19 bp, Homo sapiens
atgacttccaatttccctg

SEQ ID NO: 3385 - DNA, 19 bp, Homo sapiens
atctgccatctcgagagtt

SEQ ID NO: 3386 - DNA, 19 bp, Homo sapiens
atttgtttgtcaaagaagt

SEQ ID NO: 3387 - DNA, 19 bp, Homo sapiens
gcagagcttggcctctctg

SEQ ID NO: 3388 - DNA, 19 bp, Homo sapiens
atatgctgaaatgaaattt

SEQ ID NO: 3389 - DNA, 19 bp, Homo sapiens
tcaaaacttgacaacattt

SEQ ID NO: 3390 - DNA, 19 bp, Homo sapiens
cagtgacctgaaatacaat

SEQ ID NO: 3391 - DNA, 19 bp, Homo sapiens
tacaaatggcaatgggaaa

SEQ ID NO: 3392 - DNA, 19 bp, Homo sapiens
cttttgtaaagtatgataa

SEQ ID NO: 3393 - DNA, 19 bp, Homo sapiens
ttgtaaagtatgataaaaa

SEQ ID NO: 3394 - DNA, 19 bp, Homo sapiens
tccattaacctcccatttt

SEQ ID NO: 3395 - DNA, 19 bp, Homo sapiens
gattatctgaattcattca

SEQ ID NO: 3396 - DNA, 19 bp, Homo sapiens
aattgggagagacaagttt

SEQ ID NO: 3397 - DNA, 19 bp, Homo sapiens
atttgaaaatagctattgc

SEQ ID NO: 3398 - DNA, 19 bp, Homo sapiens
tgagcatgtcaaacacttt

SEQ ID NO: 3399 - DNA, 19 bp, Homo sapiens
ttgaagatgttaacaaatt

SEQ ID NO: 3400 - DNA, 19 bp, Homo sapiens
acttgtcacctacatttct

SEQ ID NO: 3401 - DNA, 19 bp, Homo sapiens
gttttccacaccagaattt

SEQ ID NO: 3402 - DNA, 19 bp, Homo sapiens
ataagtacaaccaaaattt

SEQ ID NO: 3403 - DNA, 19 bp, Homo sapiens
cgggacctgcggggctgag

SEQ ID NO: 3404 - DNA, 19 bp, Homo sapiens
agtgcccttctcggttgct

SEQ ID NO: 3405 - DNA, 19 bp, Homo sapiens
gctgaggagcccgcccagc

SEQ ID NO: 3406 - DNA, 19 bp, Homo sapiens
gaggagcccgcccagccag

SEQ ID NO: 3407 - DNA, 19 bp, Homo sapiens
gggccgcgaggccgaggcc

SEQ ID NO: 3408 - DNA, 19 bp, Homo sapiens
ccaggccgcagcccaggag

SEQ ID NO: 3409 - DNA, 19 bp, Homo sapiens
ggagccgccccaccgcagc

SEQ ID NO: 3410 - DNA, 19 bp, Homo sapiens
gaagaggaaatgctggaaa

SEQ ID NO: 3411 - DNA, 19 bp, Homo sapiens
caaaagatgcgacccgatt

SEQ ID NO: 3412 - DNA, 19 bp, Homo sapiens
attcaagcacctccggaag

SEQ ID NO: 3413 - DNA, 19 bp, Homo sapiens
gttccagtggagtccctgg

SEQ ID NO: 3414 - DNA, 19 bp, Homo sapiens
gactgctgattcaagaagt

SEQ ID NO: 3415 - DNA, 19 bp, Homo sapiens
gtgccaccaggatcaactg

SEQ ID NO: 3416 - DNA, 19 bp, Homo sapiens
gatcaactgcaaggttgag

SEQ ID NO: 3417 - DNA, 19 bp, Homo sapiens
actgcaaggttgagctgga

SEQ ID NO: 3418 - DNA, 19 bp, Homo sapiens
ccagctctgcagcttcatc

SEQ ID NO: 3419 - DNA, 19 bp, Homo sapiens
agcttcatcctgaagacca

SEQ ID NO: 3420 - DNA, 19 bp, Homo sapiens
cttcatcctgaagaccagc

SEQ ID NO: 3421 - DNA, 19 bp, Homo sapiens
ccagccagtgcaccctgaa

SEQ ID NO: 3422 - DNA, 19 bp, Homo sapiens
cagtgcaccctgaaagagg

SEQ ID NO: 3423 - DNA, 19 bp, Homo sapiens
tggcttcaaccctgagggc

SEQ ID NO: 3424 - DNA, 19 bp, Homo sapiens
cttcaaccctgagggcaaa

SEQ ID NO: 3425 - DNA, 19 bp, Homo sapiens
ttcaaccctgagggcaaag

SEQ ID NO: 3426 - DNA, 19 bp, Homo sapiens
cttgctgaagaaaaccaag

SEQ ID NO: 3427 - DNA, 19 bp, Homo sapiens
tgctgaagaaaaccaagaa

SEQ ID NO: 3428 - DNA, 19 bp, Homo sapiens
ttgctgcagccatgtccag

SEQ ID NO: 3429 - DNA, 19 bp, Homo sapiens
tgctgcagccatgtccagg

SEQ ID NO: 3430 - DNA, 19 bp, Homo sapiens
agccatgtccaggtatgag

SEQ ID NO: 3431 - DNA, 19 bp, Homo sapiens
agctcaagctggccattcc

SEQ ID NO: 3432 - DNA, 19 bp, Homo sapiens
agaagggaagcaggttttc

SEQ ID NO: 3433 - DNA, 19 bp, Homo sapiens
aagggaagcaggttttcct

SEQ ID NO: 3434 - DNA, 19 bp, Homo sapiens
agaaagatgaacctactta

SEQ ID NO: 3435 - DNA, 19 bp, Homo sapiens
atcctgaacatcaagaggg

SEQ ID NO: 3436 - DNA, 19 bp, Homo sapiens
tcctgaacatcaagagggg

SEQ ID NO: 3437 - DNA, 19 bp, Homo sapiens
ctgaacatcaagaggggca

SEQ ID NO: 3438 - DNA, 19 bp, Homo sapiens
aacatcaagaggggcatca

SEQ ID NO: 3439 - DNA, 19 bp, Homo sapiens
acatcaagaggggcatcat

SEQ ID NO: 3440 - DNA, 19 bp, Homo sapiens
tcatttctgccctcctggt

SEQ ID NO: 3441 - DNA, 19 bp, Homo sapiens
ttcccccagagacagaaga

SEQ ID NO: 3442 - DNA, 19 bp, Homo sapiens
gaagaagccaagcaagtgt

SEQ ID NO: 3443 - DNA, 19 bp, Homo sapiens
ttgtttctggataccgtgt

SEQ ID NO: 3444 - DNA, 19 bp, Homo sapiens
tgtatggaaactgctccac

SEQ ID NO: 3445 - DNA, 19 bp, Homo sapiens
aaactgctccactcacttt

SEQ ID NO: 3446 - DNA, 19 bp, Homo sapiens
actcactttaccgtcaaga

SEQ ID NO: 3447 - DNA, 19 bp, Homo sapiens
ctttaccgtcaagacgagg

SEQ ID NO: 3448 - DNA, 19 bp, Homo sapiens
ttaccgtcaagacgaggaa

SEQ ID NO: 3449 - DNA, 19 bp, Homo sapiens
acgaggaagggcaatgtgg

SEQ ID NO: 3450 - DNA, 19 bp, Homo sapiens
cgaggaagggcaatgtggc

SEQ ID NO: 3451 - DNA, 19 bp, Homo sapiens
gaggaagggcaatgtggca

SEQ ID NO: 3452 - DNA, 19 bp, Homo sapiens
ggaagggcaatgtggcaac

SEQ ID NO: 3453 - DNA, 19 bp, Homo sapiens
gaagggcaatgtggcaaca

SEQ ID NO: 3454 - DNA, 19 bp, Homo sapiens
caggcatcagcccacttgc

SEQ ID NO: 3455 - DNA, 19 bp, Homo sapiens
aggcatcagcccacttgct

SEQ ID NO: 3456 - DNA, 19 bp, Homo sapiens
tcagcccacttgctctcat

SEQ ID NO: 3457 - DNA, 19 bp, Homo sapiens
gtcaactctgatcagcagc

SEQ ID NO: 3458 - DNA, 19 bp, Homo sapiens
ggacgctaagaggaagcat

SEQ ID NO: 3459 - DNA, 19 bp, Homo sapiens
aaggagcaacacctcttcc

SEQ ID NO: 3460 - DNA, 19 bp, Homo sapiens
aggagcaacacctcttcct

SEQ ID NO: 3461 - DNA, 19 bp, Homo sapiens
caacacctcttcctgcctt

SEQ ID NO: 3462 - DNA, 19 bp, Homo sapiens
aacacctcttcctgccttt

SEQ ID NO: 3463 - DNA, 19 bp, Homo sapiens
acaagaataagtatgggat

SEQ ID NO: 3464 - DNA, 19 bp, Homo sapiens
caagaataagtatgggatg

SEQ ID NO: 3465 - DNA, 19 bp, Homo sapiens
tagcacaagtgacacagac

SEQ ID NO: 3466 - DNA, 19 bp, Homo sapiens
agcacaagtgacacagact

SEQ ID NO: 3467 - DNA, 19 bp, Homo sapiens
gcacaagtgacacagactt

SEQ ID NO: 3468 - DNA, 19 bp, Homo sapiens
aacttgaagacacaccaaa

SEQ ID NO: 3469 - DNA, 19 bp, Homo sapiens
gcttctttggtgaaggtac

SEQ ID NO: 3470 - DNA, 19 bp, Homo sapiens
ctttggtgaaggtactaag

SEQ ID NO: 3471 - DNA, 19 bp, Homo sapiens
tactaagaagatgggcctc

SEQ ID NO: 3472 - DNA, 19 bp, Homo sapiens
tttgagagcaccaaatcca

SEQ ID NO: 3473 - DNA, 19 bp, Homo sapiens
agagcaccaaatccacatc

SEQ ID NO: 3474 - DNA, 19 bp, Homo sapiens
agctgttttgaagactctc

SEQ ID NO: 3475 - DNA, 19 bp, Homo sapiens
tgaaaaaactaaccatctc

SEQ ID NO: 3476 - DNA, 19 bp, Homo sapiens
gaaaaaactaaccatctct

SEQ ID NO: 3477 - DNA, 19 bp, Homo sapiens
tctgagcaaaatatccaga

SEQ ID NO: 3478 - DNA, 19 bp, Homo sapiens
tctcttcaataagctggtt

SEQ ID NO: 3479 - DNA, 19 bp, Homo sapiens
ctgagctgagaggcctcag

SEQ ID NO: 3480 - DNA, 19 bp, Homo sapiens
tgaagcagtcacatctctc

SEQ ID NO: 3481 - DNA, 19 bp, Homo sapiens
aagcagtcacatctctctt

SEQ ID NO: 3482 - DNA, 19 bp, Homo sapiens
ctctcttgccacagctgat

SEQ ID NO: 3483 - DNA, 19 bp, Homo sapiens
tcttgccacagctgattga

SEQ ID NO: 3484 - DNA, 19 bp, Homo sapiens
cttgccacagctgattgag

SEQ ID NO: 3485 - DNA, 19 bp, Homo sapiens
tgaggtgtccagccccatc

SEQ ID NO: 3486 - DNA, 19 bp, Homo sapiens
tcagtgtggacagcctcag

SEQ ID NO: 3487 - DNA, 19 bp, Homo sapiens
acatcctccagtggctgaa

SEQ ID NO: 3488 - DNA, 19 bp, Homo sapiens
gcacagcagctgcgagaga

SEQ ID NO: 3489 - DNA, 19 bp, Homo sapiens
cagcagctgcgagagatct

SEQ ID NO: 3490 - DNA, 19 bp, Homo sapiens
gcgagggatcagcgcagcc

SEQ ID NO: 3491 - DNA, 19 bp, Homo sapiens
aagacaaaccctacaggga

SEQ ID NO: 3492 - DNA, 19 bp, Homo sapiens
caggagctgctggacattg

SEQ ID NO: 3493 - DNA, 19 bp, Homo sapiens
aggagctgctggacattgc

SEQ ID NO: 3494 - DNA, 19 bp, Homo sapiens
ctgctggacattgctaatt

SEQ ID NO: 3495 - DNA, 19 bp, Homo sapiens
gattacacctatttgattc

SEQ ID NO: 3496 - DNA, 19 bp, Homo sapiens
atttgattctgcgggtcat

SEQ ID NO: 3497 - DNA, 19 bp, Homo sapiens
tctgcgggtcattggaaat

SEQ ID NO: 3498 - DNA, 19 bp, Homo sapiens
aaccatggagcagttaact

SEQ ID NO: 3499 - DNA, 19 bp, Homo sapiens
ggagcagttaactccagaa

SEQ ID NO: 3500 - DNA, 19 bp, Homo sapiens
actccagaactcaagtctt

SEQ ID NO: 3501 - DNA, 19 bp, Homo sapiens
tccagaactcaagtcttca

SEQ ID NO: 3502 - DNA, 19 bp, Homo sapiens
aagtacaaagccatcactg

SEQ ID NO: 3503 - DNA, 19 bp, Homo sapiens
gccatcactgatgatccag

SEQ ID NO: 3504 - DNA, 19 bp, Homo sapiens
ccatcactgatgatccaga

SEQ ID NO: 3505 - DNA, 19 bp, Homo sapiens
atccagaaagctgccatcc

SEQ ID NO: 3506 - DNA, 19 bp, Homo sapiens
cagaaagctgccatccagg

SEQ ID NO: 3507 - DNA, 19 bp, Homo sapiens
acaaggaccaggaggttct

SEQ ID NO: 3508 - DNA, 19 bp, Homo sapiens
aggaccaggaggttcttct

SEQ ID NO: 3509 - DNA, 19 bp, Homo sapiens
accaggaggttcttcttca

SEQ ID NO: 3510 - DNA, 19 bp, Homo sapiens
tcttcagactttccttgat

SEQ ID NO: 3511 - DNA, 19 bp, Homo sapiens
ttcagactttccttgatga

SEQ ID NO: 3512 - DNA, 19 bp, Homo sapiens
gttgatgaggagtccttca

SEQ ID NO: 3513 - DNA, 19 bp, Homo sapiens
cttcacaggcagatattaa

SEQ ID NO: 3514 - DNA, 19 bp, Homo sapiens
ttcacaggcagatattaac

SEQ ID NO: 3515 - DNA, 19 bp, Homo sapiens
ggcagatattaacaaaatt

SEQ ID NO: 3516 - DNA, 19 bp, Homo sapiens
atattaacaaaattgtcca

SEQ ID NO: 3517 - DNA, 19 bp, Homo sapiens
acaaaattgtccaaattct

SEQ ID NO: 3518 - DNA, 19 bp, Homo sapiens
gagcaagtgaagaactttg

SEQ ID NO: 3519 - DNA, 19 bp, Homo sapiens
gtgaagaactttgtggctt

SEQ ID NO: 3520 - DNA, 19 bp, Homo sapiens
agaactttgtggcttccca

SEQ ID NO: 3521 - DNA, 19 bp, Homo sapiens
tttgtggcttcccatattg

SEQ ID NO: 3522 - DNA, 19 bp, Homo sapiens
tggcttcccatattgccaa

SEQ ID NO: 3523 - DNA, 19 bp, Homo sapiens
ttcccatattgccaatatc

SEQ ID NO: 3524 - DNA, 19 bp, Homo sapiens
tcccatattgccaatatct

SEQ ID NO: 3525 - DNA, 19 bp, Homo sapiens
ttgccaatatcttgaactc

SEQ ID NO: 3526 - DNA, 19 bp, Homo sapiens
ttggatatccaagatctga

SEQ ID NO: 3527 - DNA, 19 bp, Homo sapiens
tccaagatctgaaaaagtt

SEQ ID NO: 3528 - DNA, 19 bp, Homo sapiens
ctgaaaaagttagtgaaag

SEQ ID NO: 3529 - DNA, 19 bp, Homo sapiens
agttagtgaaagaagttct

SEQ ID NO: 3530 - DNA, 19 bp, Homo sapiens
aatctcaacttccaactgt

SEQ ID NO: 3531 - DNA, 19 bp, Homo sapiens
gtcatggacttcagaaaat

SEQ ID NO: 3532 - DNA, 19 bp, Homo sapiens
tcaactctacaaatctgtt

SEQ ID NO: 3533 - DNA, 19 bp, Homo sapiens
aactctacaaatctgtttc

SEQ ID NO: 3534 - DNA, 19 bp, Homo sapiens
aaatagaagggaatcttat

SEQ ID NO: 3535 - DNA, 19 bp, Homo sapiens
agaagggaatcttatattt

SEQ ID NO: 3536 - DNA, 19 bp, Homo sapiens
gaagggaatcttatatttg

SEQ ID NO: 3537 - DNA, 19 bp, Homo sapiens
tgatccaaataactacctt

SEQ ID NO: 3538 - DNA, 19 bp, Homo sapiens
tggatttgcttcagctgac

SEQ ID NO: 3539 - DNA, 19 bp, Homo sapiens
tttgcttcagctgacctca

SEQ ID NO: 3540 - DNA, 19 bp, Homo sapiens
cttggaaggaaaaggcttt

SEQ ID NO: 3541 - DNA, 19 bp, Homo sapiens
tggaaggaaaaggctttga

SEQ ID NO: 3542 - DNA, 19 bp, Homo sapiens
ggctttgagccaacattgg

SEQ ID NO: 3543 - DNA, 19 bp, Homo sapiens
tgagccaacattggaagct

SEQ ID NO: 3544 - DNA, 19 bp, Homo sapiens
gagccaacattggaagctc

SEQ ID NO: 3545 - DNA, 19 bp, Homo sapiens
aacattggaagctcttttt

SEQ ID NO: 3546 - DNA, 19 bp, Homo sapiens
tggaagctctttttgggaa

SEQ ID NO: 3547 - DNA, 19 bp, Homo sapiens
ctctttttgggaagcaagg

SEQ ID NO: 3548 - DNA, 19 bp, Homo sapiens
tttttgggaagcaaggatt

SEQ ID NO: 3549 - DNA, 19 bp, Homo sapiens
ttttcccagacagtgtcaa

SEQ ID NO: 3550 - DNA, 19 bp, Homo sapiens
ttggctataccaaagatga

SEQ ID NO: 3551 - DNA, 19 bp, Homo sapiens
ataccaaagatgataaaca

SEQ ID NO: 3552 - DNA, 19 bp, Homo sapiens
gagcaggatatggtaaatg

SEQ ID NO: 3553 - DNA, 19 bp, Homo sapiens
atggtaaatggaataatgc

SEQ ID NO: 3554 - DNA, 19 bp, Homo sapiens
tggtaaatggaataatgct

SEQ ID NO: 3555 - DNA, 19 bp, Homo sapiens
taaatggaataatgctcag

SEQ ID NO: 3556 - DNA, 19 bp, Homo sapiens
tggaataatgctcagtgtt

SEQ ID NO: 3557 - DNA, 19 bp, Homo sapiens
tcagtgttgagaagctgat

SEQ ID NO: 3558 - DNA, 19 bp, Homo sapiens
cagtgttgagaagctgatt

SEQ ID NO: 3559 - DNA, 19 bp, Homo sapiens
agtgttgagaagctgatta

SEQ ID NO: 3560 - DNA, 19 bp, Homo sapiens
gattaaagatttgaaatcc

SEQ ID NO: 3561 - DNA, 19 bp, Homo sapiens
gatttgaaatccaaagaag

SEQ ID NO: 3562 - DNA, 19 bp, Homo sapiens
atttgaaatccaaagaagt

SEQ ID NO: 3563 - DNA, 19 bp, Homo sapiens
atccaaagaagtcccggaa

SEQ ID NO: 3564 - DNA, 19 bp, Homo sapiens
tccaaagaagtcccggaag

SEQ ID NO: 3565 - DNA, 19 bp, Homo sapiens
agagcctacctccgcatct

SEQ ID NO: 3566 - DNA, 19 bp, Homo sapiens
gagcctacctccgcatctt

SEQ ID NO: 3567 - DNA, 19 bp, Homo sapiens
cttgggagaggagcttggt

SEQ ID NO: 3568 - DNA, 19 bp, Homo sapiens
ggagcttggttttgccagt

SEQ ID NO: 3569 - DNA, 19 bp, Homo sapiens
ttggttttgccagtctcca

SEQ ID NO: 3570 - DNA, 19 bp, Homo sapiens
cagtctccatgacctccag

SEQ ID NO: 3571 - DNA, 19 bp, Homo sapiens
ctccatgacctccagctcc

SEQ ID NO: 3572 - DNA, 19 bp, Homo sapiens
ctgggaaagctgcttctga

SEQ ID NO: 3573 - DNA, 19 bp, Homo sapiens
gaggtcatcaggaagggct

SEQ ID NO: 3574 - DNA, 19 bp, Homo sapiens
aagaatgacttttttcttc

SEQ ID NO: 3575 - DNA, 19 bp, Homo sapiens
cttttttcttcactacatc

SEQ ID NO: 3576 - DNA, 19 bp, Homo sapiens
catcttcatggagaatgcc

SEQ ID NO: 3577 - DNA, 19 bp, Homo sapiens
cttcatggagaatgccttt

SEQ ID NO: 3578 - DNA, 19 bp, Homo sapiens
aatgcctttgaactcccca

SEQ ID NO: 3579 - DNA, 19 bp, Homo sapiens
gcctttgaactccccactg

SEQ ID NO: 3580 - DNA, 19 bp, Homo sapiens
caaggctggagtaaaactg

SEQ ID NO: 3581 - DNA, 19 bp, Homo sapiens
tggagtaaaactggaagta

SEQ ID NO: 3582 - DNA, 19 bp, Homo sapiens
ggaagtagccaacatgcag

SEQ ID NO: 3583 - DNA, 19 bp, Homo sapiens
tttgtgacaaatatgggca

SEQ ID NO: 3584 - DNA, 19 bp, Homo sapiens
tgtgacaaatatgggcatc

SEQ ID NO: 3585 - DNA, 19 bp, Homo sapiens
ggacttcgctaggagtggg

SEQ ID NO: 3586 - DNA, 19 bp, Homo sapiens
gtggggtccagatgaacac

SEQ ID NO: 3587 - DNA, 19 bp, Homo sapiens
ttccacgagtcgggtctgg

SEQ ID NO: 3588 - DNA, 19 bp, Homo sapiens
agtcgggtctggaggctca

SEQ ID NO: 3589 - DNA, 19 bp, Homo sapiens
tcgggtctggaggctcatg

SEQ ID NO: 3590 - DNA, 19 bp, Homo sapiens
aaaagctgggaagctgaag

SEQ ID NO: 3591 - DNA, 19 bp, Homo sapiens
aagctgaagtttatcattc

SEQ ID NO: 3592 - DNA, 19 bp, Homo sapiens
gagaccagtcaagctgctc

SEQ ID NO: 3593 - DNA, 19 bp, Homo sapiens
gcaacacattacatttggt

SEQ ID NO: 3594 - DNA, 19 bp, Homo sapiens
acattacatttggtctcta

SEQ ID NO: 3595 - DNA, 19 bp, Homo sapiens
cattacatttggtctctac

SEQ ID NO: 3596 - DNA, 19 bp, Homo sapiens
aaacggaggtgatcccacc

SEQ ID NO: 3597 - DNA, 19 bp, Homo sapiens
attgagaacaggcagtcct

SEQ ID NO: 3598 - DNA, 19 bp, Homo sapiens
tgagaacaggcagtcctgg

SEQ ID NO: 3599 - DNA, 19 bp, Homo sapiens
ctgcacctcaggcgcttac

SEQ ID NO: 3600 - DNA, 19 bp, Homo sapiens
tccacagactccgcctcct

SEQ ID NO: 3601 - DNA, 19 bp, Homo sapiens
ctgaccggggacaccagat

SEQ ID NO: 3602 - DNA, 19 bp, Homo sapiens
tagagctggaactgaggcc

SEQ ID NO: 3603 - DNA, 19 bp, Homo sapiens
ctatgagctccagagagag

SEQ ID NO: 3604 - DNA, 19 bp, Homo sapiens
cttggtggataccctgaag

SEQ ID NO: 3605 - DNA, 19 bp, Homo sapiens
ttgtaactcaagcagaagg

SEQ ID NO: 3606 - DNA, 19 bp, Homo sapiens
taactcaagcagaaggtgc

SEQ ID NO: 3607 - DNA, 19 bp, Homo sapiens
gcagaaggtgcgaagcaga

SEQ ID NO: 3608 - DNA, 19 bp, Homo sapiens
cagaaggtgcgaagcagac

SEQ ID NO: 3609 - DNA, 19 bp, Homo sapiens
gtatgaccttgtccagtga

SEQ ID NO: 3610 - DNA, 19 bp, Homo sapiens
tatgaccttgtccagtgaa

SEQ ID NO: 3611 - DNA, 19 bp, Homo sapiens
gaagtccaaattccggatt

SEQ ID NO: 3612 - DNA, 19 bp, Homo sapiens
gagggcaaaacgtcttaca

SEQ ID NO: 3613 - DNA, 19 bp, Homo sapiens
agggcaaaacgtcttacag

SEQ ID NO: 3614 - DNA, 19 bp, Homo sapiens
gactcaccctggacattca

SEQ ID NO: 3615 - DNA, 19 bp, Homo sapiens
ctggacattcagaacaaga

SEQ ID NO: 3616 - DNA, 19 bp, Homo sapiens
tcatgggcgacctaagttg

SEQ ID NO: 3617 - DNA, 19 bp, Homo sapiens
tgggcgacctaagttgtga

SEQ ID NO: 3618 - DNA, 19 bp, Homo sapiens
agttgtgacacaaaggaag

SEQ ID NO: 3619 - DNA, 19 bp, Homo sapiens
tgacacaaaggaagaaaga

SEQ ID NO: 3620 - DNA, 19 bp, Homo sapiens
gacacaaaggaagaaagaa

SEQ ID NO: 3621 - DNA, 19 bp, Homo sapiens
ggaagaaagaaaaatcaag

SEQ ID NO: 3622 - DNA, 19 bp, Homo sapiens
aaaatcaagggtgttattt

SEQ ID NO: 3623 - DNA, 19 bp, Homo sapiens
tccataccccgtttgcaag

SEQ ID NO: 3624 - DNA, 19 bp, Homo sapiens
tgcaagcagaagccagaag

SEQ ID NO: 3625 - DNA, 19 bp, Homo sapiens
cagaagccagaagtgagat

SEQ ID NO: 3626 - DNA, 19 bp, Homo sapiens
tgagatcctcgcccactgg

SEQ ID NO: 3627 - DNA, 19 bp, Homo sapiens
ggtcgcctgccaaactgct

SEQ ID NO: 3628 - DNA, 19 bp, Homo sapiens
tgcttctccaaatggactc

SEQ ID NO: 3629 - DNA, 19 bp, Homo sapiens
tggactcatctgctacagc

SEQ ID NO: 3630 - DNA, 19 bp, Homo sapiens
gctacagcttatggctcca

SEQ ID NO: 3631 - DNA, 19 bp, Homo sapiens
ggtggcatggcattatgat

SEQ ID NO: 3632 - DNA, 19 bp, Homo sapiens
agagaagattgaatttgaa

SEQ ID NO: 3633 - DNA, 19 bp, Homo sapiens
caggcaccaatgtagatac

SEQ ID NO: 3634 - DNA, 19 bp, Homo sapiens
gacttccaatttccctgtg

SEQ ID NO: 3635 - DNA, 19 bp, Homo sapiens
gtccctcaaacagacatga

SEQ ID NO: 3636 - DNA, 19 bp, Homo sapiens
caaacagacatgactttcc

SEQ ID NO: 3637 - DNA, 19 bp, Homo sapiens
atagttgcaatgagctcat

SEQ ID NO: 3638 - DNA, 19 bp, Homo sapiens
gcttcagaaggcatctggg

SEQ ID NO: 3639 - DNA, 19 bp, Homo sapiens
ggagttcaacctccagaac

SEQ ID NO: 3640 - DNA, 19 bp, Homo sapiens
agaaaacctcttcttaaaa

SEQ ID NO: 3641 - DNA, 19 bp, Homo sapiens
aaaacctcttcttaaaaag

SEQ ID NO: 3642 - DNA, 19 bp, Homo sapiens
aaaaagcgatggccgggtc

SEQ ID NO: 3643 - DNA, 19 bp, Homo sapiens
gtcaaatataccttgaaca

SEQ ID NO: 3644 - DNA, 19 bp, Homo sapiens
tgaacaagaacagtttgaa

SEQ ID NO: 3645 - DNA, 19 bp, Homo sapiens
agtttgaaaattgagattc

SEQ ID NO: 3646 - DNA, 19 bp, Homo sapiens
gtttgaaaattgagattcc

SEQ ID NO: 3647 - DNA, 19 bp, Homo sapiens
ttgaaaattgagattcctt

SEQ ID NO: 3648 - DNA, 19 bp, Homo sapiens
ctaaagatgttagagactg

SEQ ID NO: 3649 - DNA, 19 bp, Homo sapiens
atgttagagactgttagga

SEQ ID NO: 3650 - DNA, 19 bp, Homo sapiens
cagccctccacttcaagtc

SEQ ID NO: 3651 - DNA, 19 bp, Homo sapiens
agccctccacttcaagtct

SEQ ID NO: 3652 - DNA, 19 bp, Homo sapiens
ccatctgccatctcgagag

SEQ ID NO: 3653 - DNA, 19 bp, Homo sapiens
attcccaagttgtatcaac

SEQ ID NO: 3654 - DNA, 19 bp, Homo sapiens
tcaactgcaagtgcctctc

SEQ ID NO: 3655 - DNA, 19 bp, Homo sapiens
ggtgttctagacctctcca

SEQ ID NO: 3656 - DNA, 19 bp, Homo sapiens
ctccacgaatgtctacagc

SEQ ID NO: 3657 - DNA, 19 bp, Homo sapiens
cacgaatgtctacagcaac

SEQ ID NO: 3658 - DNA, 19 bp, Homo sapiens
acgaatgtctacagcaact

SEQ ID NO: 3659 - DNA, 19 bp, Homo sapiens
tcctacagtggtggcaaca

SEQ ID NO: 3660 - DNA, 19 bp, Homo sapiens
cgttaccacatgaaggctg

SEQ ID NO: 3661 - DNA, 19 bp, Homo sapiens
gaaggctgactctgtggtt

SEQ ID NO: 3662 - DNA, 19 bp, Homo sapiens
tgtggttgacctgctttcc

SEQ ID NO: 3663 - DNA, 19 bp, Homo sapiens
cctgctttcctacaatgtg

SEQ ID NO: 3664 - DNA, 19 bp, Homo sapiens
ctgctttcctacaatgtgc

SEQ ID NO: 3665 - DNA, 19 bp, Homo sapiens
tcctacaatgtgcaaggat

SEQ ID NO: 3666 - DNA, 19 bp, Homo sapiens
tatgaccacaagaatacgt

SEQ ID NO: 3667 - DNA, 19 bp, Homo sapiens
atgaccacaagaatacgtc

SEQ ID NO: 3668 - DNA, 19 bp, Homo sapiens
gaatacgtctacactatca

SEQ ID NO: 3669 - DNA, 19 bp, Homo sapiens
tttctagattcgaatatca

SEQ ID NO: 3670 - DNA, 19 bp, Homo sapiens
gattcgaatatcaaattca

SEQ ID NO: 3671 - DNA, 19 bp, Homo sapiens
gaaacaacccagtctcaaa

SEQ ID NO: 3672 - DNA, 19 bp, Homo sapiens
cccagtctcaaaaggttta

SEQ ID NO: 3673 - DNA, 19 bp, Homo sapiens
ctcaaaaggtttactaata

SEQ ID NO: 3674 - DNA, 19 bp, Homo sapiens
tcaaaaggtttactaatat

SEQ ID NO: 3675 - DNA, 19 bp, Homo sapiens
aaaaggtttactaatattc

SEQ ID NO: 3676 - DNA, 19 bp, Homo sapiens
gaaacagcatttgtttgtc

SEQ ID NO: 3677 - DNA, 19 bp, Homo sapiens
atttgtttgtcaaagaagt

SEQ ID NO: 3678 - DNA, 19 bp, Homo sapiens
tcaagattgatgggcagtt

SEQ ID NO: 3679 - DNA, 19 bp, Homo sapiens
ttcagagtctcttcgttct

SEQ ID NO: 3680 - DNA, 19 bp, Homo sapiens
cagagtctcttcgttctat

SEQ ID NO: 3681 - DNA, 19 bp, Homo sapiens
atgctaaaggcacatatgg

SEQ ID NO: 3682 - DNA, 19 bp, Homo sapiens
gcacatatggcctgtcttg

SEQ ID NO: 3683 - DNA, 19 bp, Homo sapiens
gagtccaacctgaggttta

SEQ ID NO: 3684 - DNA, 19 bp, Homo sapiens
agtccaacctgaggtttaa

SEQ ID NO: 3685 - DNA, 19 bp, Homo sapiens
cctacctccaaggcaccaa

SEQ ID NO: 3686 - DNA, 19 bp, Homo sapiens
gaagatggaaccctctccc

SEQ ID NO: 3687 - DNA, 19 bp, Homo sapiens
tgatctgcaaagtggcatc

SEQ ID NO: 3688 - DNA, 19 bp, Homo sapiens
gatctgcaaagtggcatca

SEQ ID NO: 3689 - DNA, 19 bp, Homo sapiens
gcttccctaaagtatgaga

SEQ ID NO: 3690 - DNA, 19 bp, Homo sapiens
gtatgagaactacgagctg

SEQ ID NO: 3691 - DNA, 19 bp, Homo sapiens
tctaacaagatggatatga

SEQ ID NO: 3692 - DNA, 19 bp, Homo sapiens
ctgctgcgttctgaatatc

SEQ ID NO: 3693 - DNA, 19 bp, Homo sapiens
tcattgaggttcttcagcc

SEQ ID NO: 3694 - DNA, 19 bp, Homo sapiens
ttctggatcactaaattcc

SEQ ID NO: 3695 - DNA, 19 bp, Homo sapiens
ccatggtcttgagttaaat

SEQ ID NO: 3696 - DNA, 19 bp, Homo sapiens
tcttaggcactgacaaaat

SEQ ID NO: 3697 - DNA, 19 bp, Homo sapiens
acaaggcgacactaaggat

SEQ ID NO: 3698 - DNA, 19 bp, Homo sapiens
tgcaacgaccaacttgaag

SEQ ID NO: 3699 - DNA, 19 bp, Homo sapiens
caacttgaagtgtagtctc

SEQ ID NO: 3700 - DNA, 19 bp, Homo sapiens
gctggagaatgagctgaat

SEQ ID NO: 3701 - DNA, 19 bp, Homo sapiens
gcagagcttggcctctctg

SEQ ID NO: 3702 - DNA, 19 bp, Homo sapiens
tctctggggcatctatgaa

SEQ ID NO: 3703 - DNA, 19 bp, Homo sapiens
tctggggcatctatgaaat

SEQ ID NO: 3704 - DNA, 19 bp, Homo sapiens
aacacaatgcaaaattcag

SEQ ID NO: 3705 - DNA, 19 bp, Homo sapiens
ctcacagagctatcactgg

SEQ ID NO: 3706 - DNA, 19 bp, Homo sapiens
tgggaagtgcttatcaggc

SEQ ID NO: 3707 - DNA, 19 bp, Homo sapiens
ttcaaggtcagtcaagaag

SEQ ID NO: 3708 - DNA, 19 bp, Homo sapiens
aatgacatgatgggctcat

SEQ ID NO: 3709 - DNA, 19 bp, Homo sapiens
gctcatatgctgaaatgaa

SEQ ID NO: 3710 - DNA, 19 bp, Homo sapiens
atatgctgaaatgaaattt

SEQ ID NO: 3711 - DNA, 19 bp, Homo sapiens
tctgaacattgcaggctta

SEQ ID NO: 3712 - DNA, 19 bp, Homo sapiens
gaacattgcaggcttatca

SEQ ID NO: 3713 - DNA, 19 bp, Homo sapiens
tgcaggcttatcactggac

SEQ ID NO: 3714 - DNA, 19 bp, Homo sapiens
tcaaaacttgacaacattt

SEQ ID NO: 3715 - DNA, 19 bp, Homo sapiens
atttacagctctgacaagt

SEQ ID NO: 3716 - DNA, 19 bp, Homo sapiens
ctctgacaagttttataag

SEQ ID NO: 3717 - DNA, 19 bp, Homo sapiens
gttaatttacagctacagc

SEQ ID NO: 3718 - DNA, 19 bp, Homo sapiens
ttctctggtaactacttta

SEQ ID NO: 3719 - DNA, 19 bp, Homo sapiens
cctaaaaggagcctaccaa

SEQ ID NO: 3720 - DNA, 19 bp, Homo sapiens
aaaaggagcctaccaaaat

SEQ ID NO: 3721 - DNA, 19 bp, Homo sapiens
aggagcctaccaaaataat

SEQ ID NO: 3722 - DNA, 19 bp, Homo sapiens
ataatgaaataaaacacat

SEQ ID NO: 3723 - DNA, 19 bp, Homo sapiens
aaaacacatctatgccatc

SEQ ID NO: 3724 - DNA, 19 bp, Homo sapiens
tgctaaggttcagggtgtg

SEQ ID NO: 3725 - DNA, 19 bp, Homo sapiens
gagtttagccatcggctca

SEQ ID NO: 3726 - DNA, 19 bp, Homo sapiens
gctggcttcagccattgac

SEQ ID NO: 3727 - DNA, 19 bp, Homo sapiens
atttcagcaatgtcttccg

SEQ ID NO: 3728 - DNA, 19 bp, Homo sapiens
tttcagcaatgtcttccgt

SEQ ID NO: 3729 - DNA, 19 bp, Homo sapiens
ttcagcaatgtcttccgtt

SEQ ID NO: 3730 - DNA, 19 bp, Homo sapiens
cagcaatgtcttccgttct

SEQ ID NO: 3731 - DNA, 19 bp, Homo sapiens
tgtcttccgttctgtaatg

SEQ ID NO: 3732 - DNA, 19 bp, Homo sapiens
gtcttccgttctgtaatgg

SEQ ID NO: 3733 - DNA, 19 bp, Homo sapiens
atgggaaactcgctctctg

SEQ ID NO: 3734 - DNA, 19 bp, Homo sapiens
ggagaacatactgggcagc

SEQ ID NO: 3735 - DNA, 19 bp, Homo sapiens
gttgaaagcagaacctctg

SEQ ID NO: 3736 - DNA, 19 bp, Homo sapiens
gtctaggaaaagcatcagt

SEQ ID NO: 3737 - DNA, 19 bp, Homo sapiens
agcatcagtgcagctcttg

SEQ ID NO: 3738 - DNA, 19 bp, Homo sapiens
ttgaacacaaagtcagtgc

SEQ ID NO: 3739 - DNA, 19 bp, Homo sapiens
gcagacaggcacctggaaa

SEQ ID NO: 3740 - DNA, 19 bp, Homo sapiens
gaaactcaagacccaattt

SEQ ID NO: 3741 - DNA, 19 bp, Homo sapiens
acaatgaatacagccagga

SEQ ID NO: 3742 - DNA, 19 bp, Homo sapiens
cttggatgcttacaacact

SEQ ID NO: 3743 - DNA, 19 bp, Homo sapiens
ttggcgtggagcttactgg

SEQ ID NO: 3744 - DNA, 19 bp, Homo sapiens
cacttttactcagtgagcc

SEQ ID NO: 3745 - DNA, 19 bp, Homo sapiens
tttagagatgagagatgcc

SEQ ID NO: 3746 - DNA, 19 bp, Homo sapiens
gagaagccccaagaattta

SEQ ID NO: 3747 - DNA, 19 bp, Homo sapiens
caattgttgcttttgtaaa

SEQ ID NO: 3748 - DNA, 19 bp, Homo sapiens
ttttgtaaagtatgataaa

SEQ ID NO: 3749 - DNA, 19 bp, Homo sapiens
ttgtaaagtatgataaaaa

SEQ ID NO: 3750 - DNA, 19 bp, Homo sapiens
ttcactccattaacctccc

SEQ ID NO: 3751 - DNA, 19 bp, Homo sapiens
ttttgagaccttgcaagaa

SEQ ID NO: 3752 - DNA, 19 bp, Homo sapiens
accttgcaagaatattttg

SEQ ID NO: 3753 - DNA, 19 bp, Homo sapiens
tcaatattgatcaatttgt

SEQ ID NO: 3754 - DNA, 19 bp, Homo sapiens
cagagcagccctgggaaaa

SEQ ID NO: 3755 - DNA, 19 bp, Homo sapiens
cctgggaaaactcccacag

SEQ ID NO: 3756 - DNA, 19 bp, Homo sapiens
actcccacagcaagctaat

SEQ ID NO: 3757 - DNA, 19 bp, Homo sapiens
aattcattcaattgggaga

SEQ ID NO: 3758 - DNA, 19 bp, Homo sapiens
ttcaattgggagagacaag

SEQ ID NO: 3759 - DNA, 19 bp, Homo sapiens
aggagaaactgactgctct

SEQ ID NO: 3760 - DNA, 19 bp, Homo sapiens
actgactgctctcacaaaa

SEQ ID NO: 3761 - DNA, 19 bp, Homo sapiens
gactgctctcacaaaaaag

SEQ ID NO: 3762 - DNA, 19 bp, Homo sapiens
cagacatatatgatacaat

SEQ ID NO: 3763 - DNA, 19 bp, Homo sapiens
aatttgatcagtatattaa

SEQ ID NO: 3764 - DNA, 19 bp, Homo sapiens
tatgatttacatgatttga

SEQ ID NO: 3765 - DNA, 19 bp, Homo sapiens
tttgaaaatagctattgct

SEQ ID NO: 3766 - DNA, 19 bp, Homo sapiens
ttgaaaatagctattgcta

SEQ ID NO: 3767 - DNA, 19 bp, Homo sapiens
aatagctattgctaatatt

SEQ ID NO: 3768 - DNA, 19 bp, Homo sapiens
attattgatgaaatcattg

SEQ ID NO: 3769 - DNA, 19 bp, Homo sapiens
aaagtcttgatgagcacta

SEQ ID NO: 3770 - DNA, 19 bp, Homo sapiens
aagtcttgatgagcactat

SEQ ID NO: 3771 - DNA, 19 bp, Homo sapiens
ttgatgagcactatcatat

SEQ ID NO: 3772 - DNA, 19 bp, Homo sapiens
taattttagtaaaaacaat

SEQ ID NO: 3773 - DNA, 19 bp, Homo sapiens
ttttagtaaaaacaatcca

SEQ ID NO: 3774 - DNA, 19 bp, Homo sapiens
acatttgtttattgaaaat

SEQ ID NO: 3775 - DNA, 19 bp, Homo sapiens
attgattttaacaaaagtg

SEQ ID NO: 3776 - DNA, 19 bp, Homo sapiens
attttaacaaaagtggaag

SEQ ID NO: 3777 - DNA, 19 bp, Homo sapiens
aaatcagaatccagataca

SEQ ID NO: 3778 - DNA, 19 bp, Homo sapiens
gaatccagatacaagaaaa

SEQ ID NO: 3779 - DNA, 19 bp, Homo sapiens
ttaagagacacatacagaa

SEQ ID NO: 3780 - DNA, 19 bp, Homo sapiens
atccagcacctagctggaa

SEQ ID NO: 3781 - DNA, 19 bp, Homo sapiens
tgagcatgtcaaacacttt

SEQ ID NO: 3782 - DNA, 19 bp, Homo sapiens
gagcatgtcaaacactttg

SEQ ID NO: 3783 - DNA, 19 bp, Homo sapiens
aaacactttgttataaatc

SEQ ID NO: 3784 - DNA, 19 bp, Homo sapiens
tgagaaaatcaatgccttc

SEQ ID NO: 3785 - DNA, 19 bp, Homo sapiens
tatgaagtagaccaacaaa

SEQ ID NO: 3786 - DNA, 19 bp, Homo sapiens
aagtagaccaacaaatcca

SEQ ID NO: 3787 - DNA, 19 bp, Homo sapiens
aagttgaaggagactattc

SEQ ID NO: 3788 - DNA, 19 bp, Homo sapiens
acaagttaagataaaagat

SEQ ID NO: 3789 - DNA, 19 bp, Homo sapiens
aagataaaagattactttg

SEQ ID NO: 3790 - DNA, 19 bp, Homo sapiens
gattactttgagaaattag

SEQ ID NO: 3791 - DNA, 19 bp, Homo sapiens
tgagaaattagttggattt

SEQ ID NO: 3792 - DNA, 19 bp, Homo sapiens
aaattagttggatttattg

SEQ ID NO: 3793 - DNA, 19 bp, Homo sapiens
tggatttattgatgatgct

SEQ ID NO: 3794 - DNA, 19 bp, Homo sapiens
tcattgaagatgttaacaa

SEQ ID NO: 3795 - DNA, 19 bp, Homo sapiens
cattgaagatgttaacaaa

SEQ ID NO: 3796 - DNA, 19 bp, Homo sapiens
attgaagatgttaacaaat

SEQ ID NO: 3797 - DNA, 19 bp, Homo sapiens
ttgaagatgttaacaaatt

SEQ ID NO: 3798 - DNA, 19 bp, Homo sapiens
tgaagatgttaacaaattc

SEQ ID NO: 3799 - DNA, 19 bp, Homo sapiens
acatgttgataaagaaatt

SEQ ID NO: 3800 - DNA, 19 bp, Homo sapiens
tttgattaccaccagtttg

SEQ ID NO: 3801 - DNA, 19 bp, Homo sapiens
caaaatccgtgaggtgact

SEQ ID NO: 3802 - DNA, 19 bp, Homo sapiens
aaaatccgtgaggtgactc

SEQ ID NO: 3803 - DNA, 19 bp, Homo sapiens
aggtgactcagagactcaa

SEQ ID NO: 3804 - DNA, 19 bp, Homo sapiens
gtgaaattcaggctctgga

SEQ ID NO: 3805 - DNA, 19 bp, Homo sapiens
gttgcagtgtatctggaaa

SEQ ID NO: 3806 - DNA, 19 bp, Homo sapiens
ttaagttcagcatctttgg

SEQ ID NO: 3807 - DNA, 19 bp, Homo sapiens
tgaaggccaaattccgaga

SEQ ID NO: 3808 - DNA, 19 bp, Homo sapiens
aatgtatcaaatggacatt

SEQ ID NO: 3809 - DNA, 19 bp, Homo sapiens
attcagcaggaacttcaac

SEQ ID NO: 3810 - DNA, 19 bp, Homo sapiens
acctgtctctggtcagcca

SEQ ID NO: 3811 - DNA, 19 bp, Homo sapiens
cctgtctctggtcagccag

SEQ ID NO: 3812 - DNA, 19 bp, Homo sapiens
ggtcagccaggtttatagc

SEQ ID NO: 3813 - DNA, 19 bp, Homo sapiens
ccaggtttatagcacactt

SEQ ID NO: 3814 - DNA, 19 bp, Homo sapiens
gtttatagcacacttgtca

SEQ ID NO: 3815 - DNA, 19 bp, Homo sapiens
acttgtcacctacatttct

SEQ ID NO: 3816 - DNA, 19 bp, Homo sapiens
ctgattggtggactcttgc

SEQ ID NO: 3817 - DNA, 19 bp, Homo sapiens
atgaaagcattggtagagc

SEQ ID NO: 3818 - DNA, 19 bp, Homo sapiens
tgaaagcattggtagagca

SEQ ID NO: 3819 - DNA, 19 bp, Homo sapiens
gggttcactgttcctgaaa

SEQ ID NO: 3820 - DNA, 19 bp, Homo sapiens
tcaagaccatccttgggac

SEQ ID NO: 3821 - DNA, 19 bp, Homo sapiens
ccttgggaccatgcctgcc

SEQ ID NO: 3822 - DNA, 19 bp, Homo sapiens
ttcaggctcttcagaaagc

SEQ ID NO: 3823 - DNA, 19 bp, Homo sapiens
ttcagataaacttcaaaga

SEQ ID NO: 3824 - DNA, 19 bp, Homo sapiens
acttcaaagacttaaaaaa

SEQ ID NO: 3825 - DNA, 19 bp, Homo sapiens
atcccatccaggttttcca

SEQ ID NO: 3826 - DNA, 19 bp, Homo sapiens
gaatttaccatccttaaca

SEQ ID NO: 3827 - DNA, 19 bp, Homo sapiens
cattccttcctttacaatt

SEQ ID NO: 3828 - DNA, 19 bp, Homo sapiens
ttgaccagatgctgaacag

SEQ ID NO: 3829 - DNA, 19 bp, Homo sapiens
aatcaccctgccagacttc

SEQ ID NO: 3830 - DNA, 19 bp, Homo sapiens
tgaccttcacataccagaa

SEQ ID NO: 3831 - DNA, 19 bp, Homo sapiens
ttccagcttccccacatct

SEQ ID NO: 3832 - DNA, 19 bp, Homo sapiens
aagctatacagtattctga

SEQ ID NO: 3833 - DNA, 19 bp, Homo sapiens
attctgaaaatccaatctc

SEQ ID NO: 3834 - DNA, 19 bp, Homo sapiens
tttcacattagatgcaaat

SEQ ID NO: 3835 - DNA, 19 bp, Homo sapiens
caaatgctgacatagggaa

SEQ ID NO: 3836 - DNA, 19 bp, Homo sapiens
gagagtccaaattagaagt

SEQ ID NO: 3837 - DNA, 19 bp, Homo sapiens
agagtccaaattagaagtt

SEQ ID NO: 3838 - DNA, 19 bp, Homo sapiens
tctcaattttgattttcaa

SEQ ID NO: 3839 - DNA, 19 bp, Homo sapiens
caattttgattttcaagca

SEQ ID NO: 3840 - DNA, 19 bp, Homo sapiens
aatgcacaactctcaaacc

SEQ ID NO: 3841 - DNA, 19 bp, Homo sapiens
agttctccagcaagtacct

SEQ ID NO: 3842 - DNA, 19 bp, Homo sapiens
agtacctgagaacggagca

SEQ ID NO: 3843 - DNA, 19 bp, Homo sapiens
tcaaacacagtggcaagtt

SEQ ID NO: 3844 - DNA, 19 bp, Homo sapiens
acaatcagcttaccctgga

SEQ ID NO: 3845 - DNA, 19 bp, Homo sapiens
ctggatagcaacactaaat

SEQ ID NO: 3846 - DNA, 19 bp, Homo sapiens
ctgacctgcgcaacgagat

SEQ ID NO: 3847 - DNA, 19 bp, Homo sapiens
agatgagggaacacatgaa

SEQ ID NO: 3848 - DNA, 19 bp, Homo sapiens
tcaacttttctaaacttga

SEQ ID NO: 3849 - DNA, 19 bp, Homo sapiens
ttctaaacttgaaattcaa

SEQ ID NO: 3850 - DNA, 19 bp, Homo sapiens
gaaattcaatcacaagtcg

SEQ ID NO: 3851 - DNA, 19 bp, Homo sapiens
cactgtttggagaagggaa

SEQ ID NO: 3852 - DNA, 19 bp, Homo sapiens
actgtttggagaagggaag

SEQ ID NO: 3853 - DNA, 19 bp, Homo sapiens
aattctcttttcttttcag

SEQ ID NO: 3854 - DNA, 19 bp, Homo sapiens
ttcttttcagcccagccat

SEQ ID NO: 3855 - DNA, 19 bp, Homo sapiens
tttgaaagttcgttttcca

SEQ ID NO: 3856 - DNA, 19 bp, Homo sapiens
cagggaagatagacttcct

SEQ ID NO: 3857 - DNA, 19 bp, Homo sapiens
ataagtacaaccaaaattt

SEQ ID NO: 3858 - DNA, 19 bp, Homo sapiens
acaacgagaacattatgga

SEQ ID NO: 3859 - DNA, 19 bp, Homo sapiens
aggaataaatggagaagca

SEQ ID NO: 3860 - DNA, 19 bp, Homo sapiens
agcaaatctggatttctta

SEQ ID NO: 3861 - DNA, 19 bp, Homo sapiens
tcctttaacaattcctgaa

SEQ ID NO: 3862 - DNA, 19 bp, Homo sapiens
tttaacaattcctgaaatg

SEQ ID NO: 3863 - DNA, 19 bp, Homo sapiens
acacaataatcacaactcc

SEQ ID NO: 3864 - DNA, 19 bp, Homo sapiens
aagatttctctctatggga

SEQ ID NO: 3865 - DNA, 19 bp, Homo sapiens
gaaaaaacaggcttgaagg

SEQ ID NO: 3866 - DNA, 19 bp, Homo sapiens
ttgaaggaattcttgaaaa

SEQ ID NO: 3867 - DNA, 19 bp, Homo sapiens
tgaaggaattcttgaaaac

SEQ ID NO: 3868 - DNA, 19 bp, Homo sapiens
agctcagtataagaaaaac

SEQ ID NO: 3869 - DNA, 19 bp, Homo sapiens
tcaaatcctttgacaggca

SEQ ID NO: 3870 - DNA, 19 bp, Homo sapiens
atgaaacaaaaattaagtt

SEQ ID NO: 3871 - DNA, 19 bp, Homo sapiens
aattcctggatacactgtt

SEQ ID NO: 3872 - DNA, 19 bp, Homo sapiens
ttccagttgtcaatgttga

SEQ ID NO: 3873 - DNA, 19 bp, Homo sapiens
aagtgtctccattcaccat

SEQ ID NO: 3874 - DNA, 19 bp, Homo sapiens
gtcagcatgcctagtttct

SEQ ID NO: 3875 - DNA, 19 bp, Homo sapiens
ctgccatgggcaatattac

SEQ ID NO: 3876 - DNA, 19 bp, Homo sapiens
tgaataccaatgctgaact

SEQ ID NO: 3877 - DNA, 19 bp, Homo sapiens
tattgttgctcatctcctt

SEQ ID NO: 3878 - DNA, 19 bp, Homo sapiens
tgttgctcatctcctttct

SEQ ID NO: 3879 - DNA, 19 bp, Homo sapiens
tctgtcattgatgcactgc

SEQ ID NO: 3880 - DNA, 19 bp, Homo sapiens
ccacagctctgtctctgag

SEQ ID NO: 3881 - DNA, 19 bp, Homo sapiens
atttgtggagggtagtcat

SEQ ID NO: 3882 - DNA, 19 bp, Homo sapiens
atatggaagtgtcagtggc

SEQ ID NO: 3883 - DNA, 19 bp, Homo sapiens
tggaaataccaagtcaaaa

SEQ ID NO: 3884 - DNA, 19 bp, Homo sapiens
aagtcaaaacctactgtct

SEQ ID NO: 3885 - DNA, 19 bp, Homo sapiens
actgtctcttcctccatgg

SEQ ID NO: 3886 - DNA, 19 bp, Homo sapiens
cttcctccatggaatttaa

SEQ ID NO: 3887 - DNA, 19 bp, Homo sapiens
attcttcaatgctgtactc

SEQ ID NO: 3888 - DNA, 19 bp, Homo sapiens
ttgaccacaagcttagctt

SEQ ID NO: 3889 - DNA, 19 bp, Homo sapiens
cctcacctcttacttttcc

SEQ ID NO: 3890 - DNA, 19 bp, Homo sapiens
agctgcagggcacttccaa

SEQ ID NO: 3891 - DNA, 19 bp, Homo sapiens
ttccaaaattgatgatatc

SEQ ID NO: 3892 - DNA, 19 bp, Homo sapiens
gagaacatacaagcaaagc

SEQ ID NO: 3893 - DNA, 19 bp, Homo sapiens
atggcaaatgtcagctctt

SEQ ID NO: 3894 - DNA, 19 bp, Homo sapiens
tggcaaatgtcagctcttg

SEQ ID NO: 3895 - DNA, 19 bp, Homo sapiens
ttgttcaggtccatgcaag

SEQ ID NO: 3896 - DNA, 19 bp, Homo sapiens
tgttcaggtccatgcaagt

SEQ ID NO: 3897 - DNA, 19 bp, Homo sapiens
agttccttccatgatttcc

SEQ ID NO: 3898 - DNA, 19 bp, Homo sapiens
tgctaacactaagaaccag

SEQ ID NO: 3899 - DNA, 19 bp, Homo sapiens
actaagaaccagaagatca

SEQ ID NO: 3900 - DNA, 19 bp, Homo sapiens
ctaagaaccagaagatcag

SEQ ID NO: 3901 - DNA, 19 bp, Homo sapiens
cagaagatcagatggaaaa

SEQ ID NO: 3902 - DNA, 19 bp, Homo sapiens
aaaaatgaagtccggattc

SEQ ID NO: 3903 - DNA, 19 bp, Homo sapiens
gattcattctgggtctttc

SEQ ID NO: 3904 - DNA, 19 bp, Homo sapiens
aagaaaaggcacaccttga

SEQ ID NO: 3905 - DNA, 19 bp, Homo sapiens
aaggacacctaaggttcct

SEQ ID NO: 3906 - DNA, 19 bp, Homo sapiens
ccagcattggtaggagaca

SEQ ID NO: 3907 - DNA, 19 bp, Homo sapiens
ctttgtgtacaccaaaaac

SEQ ID NO: 3908 - DNA, 19 bp, Homo sapiens
ccatccctgtaaaagtttt

SEQ ID NO: 3909 - DNA, 19 bp, Homo sapiens
tgatctaaattcagttctt

SEQ ID NO: 3910 - DNA, 19 bp, Homo sapiens
aagaagctgagaacttcat

SEQ ID NO: 3911 - DNA, 19 bp, Homo sapiens
tttgccctcaacctaccaa

SEQ ID NO: 3912 - DNA, 19 bp, Homo sapiens
cttgattcccttttttgag

SEQ ID NO: 3913 - DNA, 19 bp, Homo sapiens
ttcacgcttccaaaaagtg

SEQ ID NO: 3914 - DNA, 19 bp, Homo sapiens
tgtttcagatggcattgct

SEQ ID NO: 3915 - DNA, 19 bp, Homo sapiens
aatgcagtagccaacaaga

SEQ ID NO: 3916 - DNA, 19 bp, Homo sapiens
ctgagcagaccattgagat

SEQ ID NO: 3917 - DNA, 19 bp, Homo sapiens
tgagcagaccattgagatt

SEQ ID NO: 3918 - DNA, 19 bp, Homo sapiens
ttgagattccctccattaa

SEQ ID NO: 3919 - DNA, 19 bp, Homo sapiens
acttggagtgccagtttga

SEQ ID NO: 3920 - DNA, 19 bp, Homo sapiens
caaatttgaaggacttcag

SEQ ID NO: 3921 - DNA, 19 bp, Homo sapiens
agcccagcgttcaccgatc

SEQ ID NO: 3922 - DNA, 19 bp, Homo sapiens
cagcgttcaccgatctcca

SEQ ID NO: 3923 - DNA, 19 bp, Homo sapiens
ctccatctgcgctaccaga

SEQ ID NO: 3924 - DNA, 19 bp, Homo sapiens
atgaggaaactcagatcaa

SEQ ID NO: 3925 - DNA, 19 bp, Homo sapiens
aggcagcttctggcttgct

SEQ ID NO: 3926 - DNA, 19 bp, Homo sapiens
tgaaagacaacgtgcccaa

SEQ ID NO: 3927 - DNA, 19 bp, Homo sapiens
tatgattatgtcaacaagt

SEQ ID NO: 3928 - DNA, 19 bp, Homo sapiens
cattaggcaaattgatgat

SEQ ID NO: 3929 - DNA, 19 bp, Homo sapiens
ttgactcaggaaggccaag

SEQ ID NO: 3930 - DNA, 19 bp, Homo sapiens
gaaacctgggatatacact

SEQ ID NO: 3931 - DNA, 19 bp, Homo sapiens
tcctttcgagttaaggaaa

SEQ ID NO: 3932 - DNA, 19 bp, Homo sapiens
gccattcagtctctcaaga

SEQ ID NO: 3933 - DNA, 19 bp, Homo sapiens
gtgctacgtaatcttcagg

SEQ ID NO: 3934 - DNA, 19 bp, Homo sapiens
agctgaaagagatgaaatt

SEQ ID NO: 3935 - DNA, 19 bp, Homo sapiens
aatttacttatcttattaa

SEQ ID NO: 3936 - DNA, 19 bp, Homo sapiens
ttttaaattgttgaaagaa

SEQ ID NO: 3937 - DNA, 19 bp, Homo sapiens
taatcttcataagttcaat

SEQ ID NO: 3938 - DNA, 19 bp, Homo sapiens
atattttgatccaagtata

SEQ ID NO: 3939 - DNA, 19 bp, Homo sapiens
tgaaatattatgaacttga

SEQ ID NO: 3940 - DNA, 19 bp, Homo sapiens
caatttctgcacagaaata

SEQ ID NO: 3941 - DNA, 19 bp, Homo sapiens
agaagattgcagagctttc

SEQ ID NO: 3942 - DNA, 19 bp, Homo sapiens
gaagaaaataatttctgat

SEQ ID NO: 3943 - DNA, 19 bp, Homo sapiens
ttgacctgtccattcaaaa

SEQ ID NO: 3944 - DNA, 19 bp, Homo sapiens
tcaaaactaccacacattt

SEQ ID NO: 3945 - DNA, 19 bp, Homo sapiens
ttttttaaaagaaatcttc

SEQ ID NO: 3946 - DNA, 19 bp, Homo sapiens
aggatctgagttattttgc

SEQ ID NO: 3947 - DNA, 19 bp, Homo sapiens
tttgctaaacttgggggag

SEQ ID NO: 3948 - DNA, 19 bp, Homo sapiens
cttccgttctgtaatggcc

SEQ ID NO: 3949 - DNA, 19 bp, Homo sapiens
tggaactctctccatggca

SEQ ID NO: 3950 - DNA, 19 bp, Homo sapiens
taacaaattccttgacatg

SEQ ID NO: 3951 - DNA, 19 bp, Homo sapiens
caataagatcaatagcaaa

SEQ ID NO: 3952 - DNA, 21 bp, Artificial Sequence
  Dual targeting" siRNAs
  misc_feature 20, 21: n = dT= deoxythymidine
uaccagcacccaggugcugnn

SEQ ID NO: 3953 - DNA, 21 bp, Artificial Sequence
  Dual targeting" siRNAs
  misc_feature 20,21: n = dT= deoxythymidine
ccgggcauccggacgaguunn

SEQ ID NO: 3954 - DNA, 21 bp, Artificial Sequence
  Dual targeting" siRNAs
  misc_feature 1,2: n = dT= deoxythymidine
nnaugguagugggucgacgac

SEQ ID NO: 3955 - DNA, 21 bp, Artificial Sequence
  Dual targeting" siRNAs
  misc_feature 1, 2: n = dT= deoxythymidine
nnggcccgucgcccagcucaa

SEQ ID NO: 3956 - DNA, 21 bp, Artificial Sequence
  Pseudocomplementary, bifunctional siRNA
  misc_feature 5: n = A* = 2-aminoadenine
  misc_feature 20, 21: n = dT= deoxythymidine
uaccngcacccaggugcugnn

SEQ ID NO: 3957 - DNA, 21 bp, Artificial Sequence
  Pseudocomplementary, bifunctional siRNA
  misc_feature 16: n = A* = 2-aminoadenine
  misc_feature 20, 21: n = dT= deoxythymidine
ccgggcauccggacgnguunn

SEQ ID NO: 3958 - DNA, 21 bp, Artificial Sequence
  Pseudocomplementary, bifunctional siRNA
  misc_feature 7: n = U* =2-thiouracil
  misc_feature 1, 2: n = dT= deoxythymidine
nnauggnagugggucgacgac

SEQ ID NO: 3959 - DNA, 19 bp, Homo sapiens
tccatgtcccatttacaga

SEQ ID NO: 3960 - DNA, 19 bp, Homo sapiens
tggacctgcaccaaagctg

SEQ ID NO: 3961 - DNA, 19 bp, Homo sapiens
gcagccctgggaaaactcc

SEQ ID NO: 3962 - DNA, 19 bp, Homo sapiens
tggagggtagtcataacag

SEQ ID NO: 3963 - DNA, 19 bp, Homo sapiens
tgcagagctttctgccact

SEQ ID NO: 3964 - DNA, 19 bp, Homo sapiens
agattcctttgccttttgg

SEQ ID NO: 3965 - DNA, 19 bp, Homo sapiens
aaattctcttttcttttca

SEQ ID NO: 3966 - DNA, 19 bp, Homo sapiens
tgctagtgaggccaacact

SEQ ID NO: 3967 - DNA, 19 bp, Homo sapiens
tgatgatatctggaacctt

SEQ ID NO: 3968 - DNA, 19 bp, Homo sapiens
tgctaagaaccttactgac

SEQ ID NO: 3969 - DNA, 19 bp, Homo sapiens
ttcactgttcctgaaatca

SEQ ID NO: 3970 - DNA, 19 bp, Homo sapiens
agaaaaggcacaccttgac

SEQ ID NO: 3971 - DNA, 19 bp, Homo sapiens
ttccaatttccctgtggat

SEQ ID NO: 3972 - DNA, 19 bp, Homo sapiens
acttcagagaaatacaaat

SEQ ID NO: 3973 - DNA, 19 bp, Homo sapiens
ccagacttccgtttaccag

SEQ ID NO: 3974 - DNA, 19 bp, Homo sapiens
tgaagtgtagtctcctggt

SEQ ID NO: 3975 - DNA, 19 bp, Homo sapiens
attccatcacaaatccttt

SEQ ID NO: 3976 - DNA, 19 bp, Homo sapiens
tggatctaaatgcagtagc

SEQ ID NO: 3977 - DNA, 19 bp, Homo sapiens
caaagaagtcaagattgat

SEQ ID NO: 3978 - DNA, 19 bp, Homo sapiens
atgtgttaacaaaatattc

SEQ ID NO: 3979 - DNA, 19 bp, Homo sapiens
gccagaagtgagatcctcg

SEQ ID NO: 3980 - DNA, 19 bp, Homo sapiens
ctctgagcaacaaatttgt

SEQ ID NO: 3981 - DNA, 19 bp, Homo sapiens
ctccatggcaaatgtcagc

SEQ ID NO: 3982 - DNA, 19 bp, Homo sapiens
gagtcattgaggttcttca

SEQ ID NO: 3983 - DNA, 19 bp, Homo sapiens
tgttcataagggaggtagg

SEQ ID NO: 3984 - DNA, 19 bp, Homo sapiens
atgttcataagggaggtag

SEQ ID NO: 3985 - DNA, 19 bp, Homo sapiens
gcttggttttgccagtctc

SEQ ID NO: 3986 - DNA, 19 bp, Homo sapiens
cttgaacacaaagtcagtg

SEQ ID NO: 3987 - DNA, 19 bp, Homo sapiens
actgggaagtgcttatcag

SEQ ID NO: 3988 - DNA, 19 bp, Homo sapiens
cttccccaaagagaccagt

SEQ ID NO: 3989 - DNA, 19 bp, Homo sapiens
tctggcatttactttctct

SEQ ID NO: 3990 - DNA, 19 bp, Homo sapiens
agttgaaggagactattca

SEQ ID NO: 3991 - DNA, 19 bp, Homo sapiens
ctggttactgagctgagag

SEQ ID NO: 3992 - DNA, 19 bp, Homo sapiens
agagctgccagtccttcat

SEQ ID NO: 3993 - DNA, 19 bp, Homo sapiens
cctcctacagtggtggcaa

SEQ ID NO: 3994 - DNA, 19 bp, Homo sapiens
ctggattccacatgcagct

SEQ ID NO: 3995 - DNA, 19 bp, Homo sapiens
ggaggctttaagttcagca

SEQ ID NO: 3996 - DNA, 19 bp, Homo sapiens
ttgggagagacaagtttca

SEQ ID NO: 3997 - DNA, 19 bp, Homo sapiens
tcagaagctaagcaatgtc

SEQ ID NO: 3998 - DNA, 19 bp, Homo sapiens
aggagagtccaaattagaa

SEQ ID NO: 3999 - DNA, 19 bp, Homo sapiens
tctgaattcattcaattgg

SEQ ID NO: 4000 - DNA, 19 bp, Homo sapiens
aactaccctcactgccttt

SEQ ID NO: 4001 - DNA, 19 bp, Homo sapiens
gaacctctggcatttactt

SEQ ID NO: 4002 - DNA, 19 bp, Homo sapiens
attctctggtaactacttt

SEQ ID NO: 4003 - DNA, 19 bp, Homo sapiens
catcttaggcactgacaaa

SEQ ID NO: 4004 - DNA, 19 bp, Homo sapiens
tttagccatcggctcaaca

SEQ ID NO: 4005 - DNA, 19 bp, Homo sapiens
attcctttaacaattcctg

SEQ ID NO: 4006 - DNA, 19 bp, Homo sapiens
cattcctttaacaattcct

SEQ ID NO: 4007 - DNA, 19 bp, Homo sapiens
gtcagtcttcaggctcttc

SEQ ID NO: 4008 - DNA, 19 bp, Homo sapiens
agaaggatggcattttttg

SEQ ID NO: 4009 - DNA, 19 bp, Homo sapiens
ttcagagccaaagtccatg

SEQ ID NO: 4010 - DNA, 19 bp, Homo sapiens
ttactccaacgccagctcc

SEQ ID NO: 4011 - DNA, 19 bp, Homo sapiens
ctctctggggcatctatga

SEQ ID NO: 4012 - DNA, 19 bp, Homo sapiens
ctctcaagaccacagaggt

SEQ ID NO: 4013 - DNA, 19 bp, Homo sapiens
tctgaaagacaacgtgccc

SEQ ID NO: 4014 - DNA, 19 bp, Homo sapiens
tgttgctaaggttcagggt

SEQ ID NO: 4015 - DNA, 19 bp, Homo sapiens
cacaaattagtttcaccat

SEQ ID NO: 4016 - DNA, 19 bp, Homo sapiens
attccagcttccccacatc

SEQ ID NO: 4017 - DNA, 19 bp, Homo sapiens
ttttttggaaatgccattg

SEQ ID NO: 4018 - DNA, 19 bp, Homo sapiens
tcatgtgatgggtctctac

SEQ ID NO: 4019 - DNA, 19 bp, Homo sapiens
agtcaagaaggacttaagc

SEQ ID NO: 4020 - DNA, 19 bp, Homo sapiens
gacttcagagaaatacaaa

SEQ ID NO: 4021 - DNA, 19 bp, Homo sapiens
tgacttcagagaaatacaa

SEQ ID NO: 4022 - DNA, 19 bp, Homo sapiens
agcgagaatcaccctgcca

SEQ ID NO: 4023 - DNA, 19 bp, Homo sapiens
aaaggagatgtcaagggtt

SEQ ID NO: 4024 - DNA, 19 bp, Homo sapiens
tcatttgaaagaataaatg

SEQ ID NO: 4025 - DNA, 19 bp, Homo sapiens
taagaaccttactgacttt

SEQ ID NO: 4026 - DNA, 19 bp, Homo sapiens
aaggacttcaggaatggga

SEQ ID NO: 4027 - DNA, 19 bp, Homo sapiens
aaattaaaaagtcttgatg

SEQ ID NO: 4028 - DNA, 19 bp, Homo sapiens
taaaccaaaacttggttta

SEQ ID NO: 4029 - DNA, 19 bp, Homo sapiens
ttcaaagacttaaaaaata

SEQ ID NO: 4030 - DNA, 19 bp, Homo sapiens
ataaagaaattaaagtcat

SEQ ID NO: 4031 - DNA, 19 bp, Homo sapiens
atatattgtcagtgcctct

SEQ ID NO: 4032 - DNA, 19 bp, Homo sapiens
tctaaattcagttcttgtc

SEQ ID NO: 4033 - DNA, 19 bp, Homo sapiens
acaaagtcagtgccctgct

SEQ ID NO: 4034 - DNA, 19 bp, Homo sapiens
cctttgtgtacaccaaaaa

SEQ ID NO: 4035 - DNA, 19 bp, Homo sapiens
gcctttgtgtacaccaaaa

SEQ ID NO: 4036 - DNA, 19 bp, Homo sapiens
ttcagaaatactgttttcc

SEQ ID NO: 4037 - DNA, 19 bp, Homo sapiens
ctgggacctaccaagagtg

SEQ ID NO: 4038 - DNA, 19 bp, Homo sapiens
cacatttcaaggaattgtg

SEQ ID NO: 4039 - DNA, 19 bp, Homo sapiens
ggaactgttgactcaggaa

SEQ ID NO: 4040 - DNA, 19 bp, Homo sapiens
agagccaggtcgagctttc

SEQ ID NO: 4041 - DNA, 19 bp, Homo sapiens
acagctgaaagagatgaaa

SEQ ID NO: 4042 - DNA, 19 bp, Homo sapiens
ctgcacgctttgaggtaga

SEQ ID NO: 4043 - DNA, 19 bp, Homo sapiens
actgcacgctttgaggtag

SEQ ID NO: 4044 - DNA, 19 bp, Homo sapiens
ttggccaggaagtggccct

SEQ ID NO: 4045 - DNA, 19 bp, Homo sapiens
ctttttcaccaacggagaa

SEQ ID NO: 4046 - DNA, 19 bp, Homo sapiens
ataaactgcaagatttttc

SEQ ID NO: 4047 - DNA, 19 bp, Homo sapiens
agaaaatcaggatctgagt

SEQ ID NO: 4048 - DNA, 19 bp, Homo sapiens
gattaccaccagcagttta

SEQ ID NO: 4049 - DNA, 19 bp, Homo sapiens
cttcgtgaagaatattttg

SEQ ID NO: 4050 - DNA, 19 bp, Homo sapiens
aacacttacttgaattcca

SEQ ID NO: 4051 - DNA, 19 bp, Homo sapiens
cttcagagaaatacaaatc

SEQ ID NO: 4052 - DNA, 19 bp, Homo sapiens
acttcagagaaatacaaat

SEQ ID NO: 4053 - DNA, 19 bp, Homo sapiens
caaagaagtcaagattgat

SEQ ID NO: 4054 - DNA, 19 bp, Homo sapiens
ctggaaagttaaaacaaca

SEQ ID NO: 4055 - DNA, 19 bp, Homo sapiens
accaaagctggcaccaggg

SEQ ID NO: 4056 - DNA, 19 bp, Homo sapiens
aaagccattcagtctctca

SEQ ID NO: 4057 - DNA, 19 bp, Homo sapiens
acttttctaaacttgaaat

SEQ ID NO: 4058 - DNA, 19 bp, Homo sapiens
ttccggggaaacctgggat

SEQ ID NO: 4059 - DNA, 19 bp, Homo sapiens
agatggtacgttagcctct

SEQ ID NO: 4060 - DNA, 19 bp, Homo sapiens
tgggaactacaatttcatt

SEQ ID NO: 4061 - DNA, 19 bp, Homo sapiens
aatcttcaatttattcttc

SEQ ID NO: 4062 - DNA, 19 bp, Homo sapiens
cttcaggttccatcgtgca

SEQ ID NO: 4063 - DNA, 19 bp, Homo sapiens
caaaacctactgtctcttc

SEQ ID NO: 4064 - DNA, 19 bp, Homo sapiens
ccatatgaaagtcaagcat

SEQ ID NO: 4065 - DNA, 19 bp, Homo sapiens
cagattctcagatgaggga

SEQ ID NO: 4066 - DNA, 19 bp, Homo sapiens
acttttctaaacttgaaat

SEQ ID NO: 4067 - DNA, 19 bp, Homo sapiens
attatgttgaaacagtcct

SEQ ID NO: 4068 - DNA, 19 bp, Homo sapiens
attgttgctcatctccttt

SEQ ID NO: 4069 - DNA, 19 bp, Homo sapiens
ttctgattaccaccagcag

SEQ ID NO: 4070 - DNA, 19 bp, Homo sapiens
ttttaaaagaaatcttcaa

SEQ ID NO: 4071 - DNA, 19 bp, Homo sapiens
caaaacctactgtctcttc

SEQ ID NO: 4072 - DNA, 19 bp, Homo sapiens
aaatgtcagctcttgttca

SEQ ID NO: 4073 - DNA, 19 bp, Homo sapiens
gcaagtcagcccagttcct

SEQ ID NO: 4074 - DNA, 19 bp, Homo sapiens
cagccattgacatgagcac

SEQ ID NO: 4075 - DNA, 19 bp, Homo sapiens
cagctccacagactccgcc

SEQ ID NO: 4076 - DNA, 19 bp, Homo sapiens
agcagaaggtgcgaagcag

SEQ ID NO: 4077 - DNA, 19 bp, Homo sapiens
cctggattccacatgcagc

SEQ ID NO: 4078 - DNA, 19 bp, Homo sapiens
tttttcttcactacatctt

SEQ ID NO: 4079 - DNA, 19 bp, Homo sapiens
ccagacttccacatcccag

SEQ ID NO: 4080 - DNA, 19 bp, Homo sapiens
agcatgcctagtttctcca

SEQ ID NO: 4081 - DNA, 19 bp, Homo sapiens
cagcatgcctagtttctcc

SEQ ID NO: 4082 - DNA, 19 bp, Homo sapiens
tcttccatcacttgaccca

SEQ ID NO: 4083 - DNA, 19 bp, Homo sapiens
gcacaccttgacattgcag

SEQ ID NO: 4084 - DNA, 19 bp, Homo sapiens
gcaggctgaactggtggca

SEQ ID NO: 4085 - DNA, 19 bp, Homo sapiens
tgcaggctgaactggtggc

SEQ ID NO: 4086 - DNA, 19 bp, Homo sapiens
cctccacctctgatctgca

SEQ ID NO: 4087 - DNA, 21 bp, Artificial Sequence
  Pseudocomplementary, bifunctional siRNA
  misc_feature 1, 2: n = dT= deoxythymidine
  misc_feature 18: n = 2-thiouracil
nnggcccgucgcccagcncaa

SEQ ID NO: 4088 - DNA, 19 bp, Human hepatitis C virus
ttttttttttttttttttt

SEQ ID NO: 4089 - DNA, 19 bp, Homo sapiens
aacccctacatgaagcttg

SEQ ID NO: 4090 - DNA, 19 bp, Homo sapiens
tcaggaagcttctcaagag

SEQ ID NO: 4091 - DNA, 19 bp, Homo sapiens
ggtcttgagttaaatgctg

SEQ ID NO: 4092 - DNA, 19 bp, Homo sapiens
ctggacgctaagaggaagc

SEQ ID NO: 4093 - DNA, 19 bp, Homo sapiens
tggcatggcattatgatga

SEQ ID NO: 4094 - DNA, 19 bp, Homo sapiens
ctcaaccttaatgattttc

SEQ ID NO: 4095 - DNA, 19 bp, Homo sapiens
gcaagctatacagtattct

SEQ ID NO: 4096 - DNA, 19 bp, Homo sapiens
ctgcaggggatcccccaga

SEQ ID NO: 4097 - DNA, 19 bp, Homo sapiens
tggaagtgtcagtggcaaa

SEQ ID NO: 4098 - DNA, 19 bp, Homo sapiens
agaataaatgacgttcttg

SEQ ID NO: 4099 - DNA, 19 bp, Homo sapiens
cgtctacactatcatgtga

SEQ ID NO: 4100 - DNA, 19 bp, Homo sapiens
tccttgacatgttgataaa

SEQ ID NO: 4101 - DNA, 19 bp, Homo sapiens
ttccagaaagcagccagtg

SEQ ID NO: 4102 - DNA, 19 bp, Homo sapiens
cttcatacacattaatcct

SEQ ID NO: 4103 - DNA, 19 bp, Homo sapiens
gaagtagtactgcatcttg

SEQ ID NO: 4104 - DNA, 19 bp, Homo sapiens
ttcaattcttcaatgctgt

SEQ ID NO: 4105 - DNA, 19 bp, Homo sapiens
agatttgaggattccatca

SEQ ID NO: 4106 - DNA, 19 bp, Homo sapiens
caaggagaaactgactgct

SEQ ID NO: 4107 - DNA, 19 bp, Homo sapiens
tgtagtctcctggtgctgg

SEQ ID NO: 4108 - DNA, 19 bp, Homo sapiens
ctggagcttagtaatggag

SEQ ID NO: 4109 - DNA, 19 bp, Homo sapiens
tcagatgagggaacacatg

SEQ ID NO: 4110 - DNA, 19 bp, Homo sapiens
gccaccctggaactctctc

SEQ ID NO: 4111 - DNA, 19 bp, Homo sapiens
tgatcccacctctcattga

SEQ ID NO: 4112 - DNA, 19 bp, Homo sapiens
ctcagggatctgaaggtgg

SEQ ID NO: 4113 - DNA, 19 bp, Homo sapiens
tcttgagttaaatgctgac

SEQ ID NO: 4114 - DNA, 19 bp, Homo sapiens
aggtatattcgaaagtcca

SEQ ID NO: 4115 - DNA, 19 bp, Homo sapiens
caggtatattcgaaagtcc

SEQ ID NO: 4116 - DNA, 19 bp, Homo sapiens
tttcacatgccaaggagaa

SEQ ID NO: 4117 - DNA, 19 bp, Homo sapiens
ttgaagtgtagtctcctgg

SEQ ID NO: 4118 - DNA, 19 bp, Homo sapiens
catttctgattggtggact

SEQ ID NO: 4119 - DNA, 19 bp, Homo sapiens
aaagtgccacttttactca

SEQ ID NO: 4120 - DNA, 19 bp, Homo sapiens
acaaagtcagtgccctgct

SEQ ID NO: 4121 - DNA, 19 bp, Homo sapiens
aagtccataatggttcaga

SEQ ID NO: 4122 - DNA, 19 bp, Homo sapiens
ttctgaatatattgtcagt

SEQ ID NO: 4123 - DNA, 19 bp, Homo sapiens
ggctcaccctgagagaagt

SEQ ID NO: 4124 - DNA, 19 bp, Homo sapiens
aggaagatatgaagatgga

SEQ ID NO: 4125 - DNA, 19 bp, Homo sapiens
caaatttgtggagggtagt

SEQ ID NO: 4126 - DNA, 19 bp, Homo sapiens
tcagtataagtacaaccaa

SEQ ID NO: 4127 - DNA, 19 bp, Homo sapiens
tcccgattcacgcttccaa

SEQ ID NO: 4128 - DNA, 19 bp, Homo sapiens
cttcagaaagctaccttcc

SEQ ID NO: 4129 - DNA, 19 bp, Homo sapiens
tgaccttctctaagcaaaa

SEQ ID NO: 4130 - DNA, 19 bp, Homo sapiens
agcttggttttgccagtct

SEQ ID NO: 4131 - DNA, 19 bp, Homo sapiens
atctcgtgtctaggaaaag

SEQ ID NO: 4132 - DNA, 19 bp, Homo sapiens
ctcaaggataacgtgtttg

SEQ ID NO: 4133 - DNA, 19 bp, Homo sapiens
ttatcttattaattatatc

SEQ ID NO: 4134 - DNA, 19 bp, Homo sapiens
caacacttacttgaattcc

SEQ ID NO: 4135 - DNA, 19 bp, Homo sapiens
gacttcagagaaatacaaa

SEQ ID NO: 4136 - DNA, 19 bp, Homo sapiens
tccaatttccctgtggatc

SEQ ID NO: 4137 - DNA, 19 bp, Homo sapiens
tgaccacacaaacagtctg

SEQ ID NO: 4138 - DNA, 19 bp, Homo sapiens
tgaagtccggattcattct

SEQ ID NO: 4139 - DNA, 19 bp, Homo sapiens
cagctcaaccgtacagttc

SEQ ID NO: 4140 - DNA, 19 bp, Homo sapiens
tgacttcagtgcagaatat

SEQ ID NO: 4141 - DNA, 19 bp, Homo sapiens
tggccccgtttaccatgac

SEQ ID NO: 4142 - DNA, 19 bp, Homo sapiens
aggaggctttaagttcagc

SEQ ID NO: 4143 - DNA, 19 bp, Homo sapiens
gtctcttcctccatggaat

SEQ ID NO: 4144 - DNA, 19 bp, Homo sapiens
actgactgcacgctttgag

SEQ ID NO: 4145 - DNA, 19 bp, Homo sapiens
ctgagagaagtgtcttcaa

SEQ ID NO: 4146 - DNA, 19 bp, Homo sapiens
ggacggtactgtcccaggt

SEQ ID NO: 4147 - DNA, 19 bp, Homo sapiens
ggaaggcagagtttactgg

SEQ ID NO: 4148 - DNA, 19 bp, Homo sapiens
atttcctaaagctggatgt

SEQ ID NO: 4149 - DNA, 19 bp, Homo sapiens
ataaactgcaagatttttc

SEQ ID NO: 4150 - DNA, 19 bp, Homo sapiens
gaaacaatgcattagattt

SEQ ID NO: 4151 - DNA, 19 bp, Homo sapiens
tctcccgtgtataatgcca

SEQ ID NO: 4152 - DNA, 19 bp, Homo sapiens
tcaaaacctactgtctctt

SEQ ID NO: 4153 - DNA, 19 bp, Homo sapiens
gggaactacaatttcattt

SEQ ID NO: 4154 - DNA, 19 bp, Homo sapiens
caggctgattacgagtcat

SEQ ID NO: 4155 - DNA, 19 bp, Homo sapiens
ccacgaaaaatatggaagt

SEQ ID NO: 4156 - DNA, 19 bp, Homo sapiens
ccatcagttcagataaact

SEQ ID NO: 4157 - DNA, 19 bp, Homo sapiens
attgacctgtccattcaaa

SEQ ID NO: 4158 - DNA, 19 bp, Homo sapiens
ctggaattgtcattccttc

SEQ ID NO: 4159 - DNA, 19 bp, Homo sapiens
ttttaacaaaagtggaagt

SEQ ID NO: 4160 - DNA, 19 bp, Homo sapiens
catcactgccaaaggagag

SEQ ID NO: 4161 - DNA, 19 bp, Homo sapiens
tgactcactcattgatttt

SEQ ID NO: 4162 - DNA, 19 bp, Homo sapiens
ccacaaacaatgaagggaa

SEQ ID NO: 4163 - DNA, 19 bp, Homo sapiens
atgggaaaaaacaggcttg

SEQ ID NO: 4164 - DNA, 19 bp, Homo sapiens
atgggaagtataagaactt

SEQ ID NO: 4165 - DNA, 19 bp, Homo sapiens
agaaaaacaaacacaggca

SEQ ID NO: 4166 - DNA, 19 bp, Homo sapiens
tgaagtgtagtctcctggt

SEQ ID NO: 4167 - DNA, 19 bp, Homo sapiens
ctgaaatacaatgctctgg

SEQ ID NO: 4168 - DNA, 19 bp, Homo sapiens
agacacctgattttatagt

SEQ ID NO: 4169 - DNA, 19 bp, Homo sapiens
tgaaggctgactctgtggt

SEQ ID NO: 4170 - DNA, 19 bp, Homo sapiens
ctgagcaacaaatttgtgg

SEQ ID NO: 4171 - DNA, 19 bp, Homo sapiens
tttctctcatgattacaaa

SEQ ID NO: 4172 - DNA, 19 bp, Homo sapiens
tcaaggataacgtgtttga

SEQ ID NO: 4173 - DNA, 19 bp, Homo sapiens
gtcagatattgttgctcat

SEQ ID NO: 4174 - DNA, 19 bp, Homo sapiens
cattcattgaagatgttaa

SEQ ID NO: 4175 - DNA, 19 bp, Homo sapiens
ggcaaatttgaaggacttc

SEQ ID NO: 4176 - DNA, 19 bp, Homo sapiens
tggcaaatttgaaggactt

SEQ ID NO: 4177 - DNA, 19 bp, Homo sapiens
cagaatccagatacaagaa

SEQ ID NO: 4178 - DNA, 19 bp, Homo sapiens
tgggtctttccagagccag

SEQ ID NO: 4179 - DNA, 19 bp, Homo sapiens
tgagaagccccaagaattt

SEQ ID NO: 4180 - DNA, 19 bp, Homo sapiens
tcaaattcctggatacact

SEQ ID NO: 4181 - DNA, 19 bp, Homo sapiens
cctgaccttcacataccag

SEQ ID NO: 4182 - DNA, 19 bp, Homo sapiens
aagtaaaagaaaattttgc

SEQ ID NO: 4183 - DNA, 19 bp, Homo sapiens
tgaagtaaaagaaaatttt

SEQ ID NO: 4184 - DNA, 19 bp, Homo sapiens
ttaaggacttccattctga

SEQ ID NO: 4185 - DNA, 19 bp, Homo sapiens
agcccatcaatatcattga

SEQ ID NO: 4186 - DNA, 19 bp, Homo sapiens
tgtttcaactgcctttgtg

SEQ ID NO: 4187 - DNA, 19 bp, Homo sapiens
tgttttcctatttccaaga

SEQ ID NO: 4188 - DNA, 19 bp, Homo sapiens
agttattttgctaaacttg

SEQ ID NO: 4189 - DNA, 19 bp, Homo sapiens
ctgtttttagaggaaacca

SEQ ID NO: 4190 - DNA, 19 bp, Homo sapiens
tgtatagcaaattcctgtt

SEQ ID NO: 4191 - DNA, 19 bp, Homo sapiens
gttccttccatgatttccc

SEQ ID NO: 4192 - DNA, 19 bp, Homo sapiens
gagacagcatcttcgtgtt

SEQ ID NO: 4193 - DNA, 19 bp, Homo sapiens
ctgctaagaaccttactga

SEQ ID NO: 4194 - DNA, 19 bp, Homo sapiens
cctttcaagcactgactgc

SEQ ID NO: 4195 - DNA, 19 bp, Homo sapiens
ccaggttttccacaccaga

SEQ ID NO: 4196 - DNA, 19 bp, Homo sapiens
ctttttcaccaacggagaa

SEQ ID NO: 4197 - DNA, 19 bp, Homo sapiens
caggaggctttaagttcag

SEQ ID NO: 4198 - DNA, 19 bp, Homo sapiens
attccttcctttacaattg

SEQ ID NO: 4199 - DNA, 19 bp, Homo sapiens
gtcagcccagttccttcca

SEQ ID NO: 4200 - DNA, 19 bp, Homo sapiens
tgggctaaacgtatgaaag

SEQ ID NO: 4201 - DNA, 19 bp, Homo sapiens
atcttcataagttcaatga

SEQ ID NO: 4202 - DNA, 19 bp, Homo sapiens
gagtgaaatgctgtttttt

SEQ ID NO: 4203 - DNA, 19 bp, Homo sapiens
taatgattttcaagttcct

SEQ ID NO: 4204 - DNA, 19 bp, Homo sapiens
acgttagcctctaagacta

SEQ ID NO: 4205 - DNA, 19 bp, Homo sapiens
cttttacaattcattttcc

SEQ ID NO: 4206 - DNA, 19 bp, Homo sapiens
gctttctcttccacatttc

SEQ ID NO: 4207 - DNA, 19 bp, Homo sapiens
attgatgttagagtgcttt

SEQ ID NO: 4208 - DNA, 19 bp, Homo sapiens
tattgatgttagagtgctt

SEQ ID NO: 4209 - DNA, 19 bp, Homo sapiens
tcaaccttaatgattttca

SEQ ID NO: 4210 - DNA, 19 bp, Homo sapiens
caaagccatcactgatgat

SEQ ID NO: 4211 - DNA, 19 bp, Homo sapiens
tgaaatcattgaaaaatta

SEQ ID NO: 4212 - DNA, 19 bp, Homo sapiens
tgaagtagctgagaaaatc

SEQ ID NO: 4213 - DNA, 19 bp, Homo sapiens
aaacattcctttaacaatt

SEQ ID NO: 4214 - DNA, 19 bp, Homo sapiens
tattgaaaatattgatttt

SEQ ID NO: 4215 - DNA, 19 bp, Homo sapiens
atcatatccgtgtaatttt

SEQ ID NO: 4216 - DNA, 19 bp, Homo sapiens
ttaatcttcataagttcaa

SEQ ID NO: 4217 - DNA, 19 bp, Homo sapiens
agcttggttttgccagtct

SEQ ID NO: 4218 - DNA, 19 bp, Homo sapiens
attccttcctttacaattg

SEQ ID NO: 4219 - DNA, 19 bp, Homo sapiens
aattgttgaaagaaaacct

SEQ ID NO: 4220 - DNA, 19 bp, Homo sapiens
ggacaaggcccagaatctg

SEQ ID NO: 4221 - DNA, 19 bp, Homo sapiens
aaagaaaacctatgcctta

SEQ ID NO: 4222 - DNA, 19 bp, Homo sapiens
atttcttaaacattccttt

SEQ ID NO: 4223 - DNA, 19 bp, Homo sapiens
taaagccattcagtctctc

SEQ ID NO: 4224 - DNA, 19 bp, Homo sapiens
gacatgttgataaagaaat

SEQ ID NO: 4225 - DNA, 19 bp, Homo sapiens
atgtatcaaatggacattc

SEQ ID NO: 4226 - DNA, 19 bp, Homo sapiens
atctggaaccttgaagtaa

SEQ ID NO: 4227 - DNA, 19 bp, Homo sapiens
cttttcacattagatgcaa

SEQ ID NO: 4228 - DNA, 19 bp, Homo sapiens
ttgaaggacttcaggaatg

SEQ ID NO: 4229 - DNA, 19 bp, Homo sapiens
ggactcaaggataacgtgt

SEQ ID NO: 4230 - DNA, 19 bp, Homo sapiens
atcttcaatgattatatcc

SEQ ID NO: 4231 - DNA, 19 bp, Homo sapiens
tttatgattatgtcaacaa

SEQ ID NO: 4232 - DNA, 19 bp, Homo sapiens
actggacttctctagtcag

SEQ ID NO: 4233 - DNA, 19 bp, Homo sapiens
gaaaaatgaagtccggatt

SEQ ID NO: 4234 - DNA, 19 bp, Homo sapiens
tttgcaagttaaagaaaat

SEQ ID NO: 4235 - DNA, 19 bp, Homo sapiens
atttgatttaagtgtaaaa

SEQ ID NO: 4236 - DNA, 19 bp, Homo sapiens
tgcaagttaaagaaaatca

SEQ ID NO: 4237 - DNA, 19 bp, Homo sapiens
cattggtaggagacagcat

SEQ ID NO: 4238 - DNA, 19 bp, Homo sapiens
gcattggtaggagacagca

SEQ ID NO: 4239 - DNA, 19 bp, Homo sapiens
agctagagggcctcttttt

SEQ ID NO: 4240 - DNA, 19 bp, Homo sapiens
tccactcacatcctccagt

SEQ ID NO: 4241 - DNA, 19 bp, Homo sapiens
catgaacccctacatgaag

SEQ ID NO: 4242 - DNA, 19 bp, Homo sapiens
atttgaaagttcgttttcc

SEQ ID NO: 4243 - DNA, 19 bp, Homo sapiens
gagaacattatggaggccc

SEQ ID NO: 4244 - DNA, 19 bp, Homo sapiens
gtgtcttcaaagctgagaa

SEQ ID NO: 4245 - DNA, 19 bp, Homo sapiens
attccagcttccccacatc

SEQ ID NO: 4246 - DNA, 19 bp, Homo sapiens
cttatgggatttcctaaag

SEQ ID NO: 4247 - DNA, 19 bp, Homo sapiens
cttcatctgtcattgatgc

SEQ ID NO: 4248 - DNA, 19 bp, Homo sapiens
attccctgaagttgatgtg

SEQ ID NO: 4249 - DNA, 19 bp, Homo sapiens
tccatcacaaatcctttgg

SEQ ID NO: 4250 - DNA, 19 bp, Homo sapiens
ttccatcacaaatcctttg

SEQ ID NO: 4251 - DNA, 19 bp, Homo sapiens
tctcaagagttacagcaga

SEQ ID NO: 4252 - DNA, 19 bp, Homo sapiens
ttctcaagagttacagcag

SEQ ID NO: 4253 - DNA, 19 bp, Homo sapiens
tgggcctgccccagattct

SEQ ID NO: 4254 - DNA, 19 bp, Homo sapiens
gaaatcttcaatttattct

SEQ ID NO: 4255 - DNA, 19 bp, Homo sapiens
tttttgcaagttaaagaaa

SEQ ID NO: 4256 - DNA, 19 bp, Homo sapiens
aaagaaaatcaggatctga

SEQ ID NO: 4257 - DNA, 19 bp, Homo sapiens
atctatgccatctcttctg

SEQ ID NO: 4258 - DNA, 19 bp, Homo sapiens
atggagtctttattgtgta

SEQ ID NO: 4259 - DNA, 19 bp, Homo sapiens
tgagaactacgagctgact

SEQ ID NO: 4260 - DNA, 19 bp, Homo sapiens
actggtggcaaaaccctcc

SEQ ID NO: 4261 - DNA, 19 bp, Homo sapiens
attgaagtacctacttttg

SEQ ID NO: 4262 - DNA, 19 bp, Homo sapiens
aattgaagtacctactttt

SEQ ID NO: 4263 - DNA, 19 bp, Homo sapiens
cattatggcccttcgtgaa

SEQ ID NO: 4264 - DNA, 19 bp, Homo sapiens
tcaaaagaagcccaagagg

SEQ ID NO: 4265 - DNA, 19 bp, Homo sapiens
caagcatctgattgactca

SEQ ID NO: 4266 - DNA, 19 bp, Homo sapiens
cttgaacacaaagtcagtg

SEQ ID NO: 4267 - DNA, 19 bp, Homo sapiens
caaaaacattttcaacttc

SEQ ID NO: 4268 - DNA, 19 bp, Homo sapiens
ccatttacagatcttcagg

SEQ ID NO: 4269 - DNA, 19 bp, Homo sapiens
ctggattccacatgcagct

SEQ ID NO: 4270 - DNA, 19 bp, Homo sapiens
atcatatccgtgtaatttt

SEQ ID NO: 4271 - DNA, 19 bp, Homo sapiens
aaagctgagaagaaatctg

SEQ ID NO: 4272 - DNA, 19 bp, Homo sapiens
caaagctgagaagaaatct

SEQ ID NO: 4273 - DNA, 19 bp, Homo sapiens
atccaagatgagatcaaca

SEQ ID NO: 4274 - DNA, 19 bp, Homo sapiens
caactctctgattactatg

SEQ ID NO: 4275 - DNA, 19 bp, Homo sapiens
cttcaatttattcttcttt

SEQ ID NO: 4276 - DNA, 19 bp, Homo sapiens
cttcaaagacttaaaaaat

SEQ ID NO: 4277 - DNA, 19 bp, Homo sapiens
tctcttcctccatggaatt

SEQ ID NO: 4278 - DNA, 19 bp, Homo sapiens
tcttcataagttcaatgaa

SEQ ID NO: 4279 - DNA, 19 bp, Homo sapiens
ctgttgaaagatttatcaa

SEQ ID NO: 4280 - DNA, 19 bp, Homo sapiens
actcaatggtgaaattcag

SEQ ID NO: 4281 - DNA, 19 bp, Homo sapiens
ttcagaagctaagcaatgt

SEQ ID NO: 4282 - DNA, 19 bp, Homo sapiens
ttttggcaagctatacagt

SEQ ID NO: 4283 - DNA, 19 bp, Homo sapiens
ttgcaagcaagtctttcct

SEQ ID NO: 4284 - DNA, 19 bp, Homo sapiens
ttctctctatgggaaaaaa

SEQ ID NO: 4285 - DNA, 19 bp, Homo sapiens
tgaaatgctgttttttgga

SEQ ID NO: 4286 - DNA, 19 bp, Homo sapiens
agaatctgtaccaggaact

SEQ ID NO: 4287 - DNA, 19 bp, Homo sapiens
acttcagagaaatacaaat

SEQ ID NO: 4288 - DNA, 19 bp, Homo sapiens
tgaaaccaatgacaaaatc

SEQ ID NO: 4289 - DNA, 19 bp, Homo sapiens
cagctgagcagacaggcac

SEQ ID NO: 4290 - DNA, 19 bp, Homo sapiens
cttcataagttcaatgaat

SEQ ID NO: 4291 - DNA, 19 bp, Homo sapiens
acttcccaactctcaagtc

SEQ ID NO: 4292 - DNA, 19 bp, Homo sapiens
ctgggcagctgtatagcaa

SEQ ID NO: 4293 - DNA, 19 bp, Homo sapiens
taagtatgatttcaattct

SEQ ID NO: 4294 - DNA, 19 bp, Homo sapiens
agttcaatgaatttattca

SEQ ID NO: 4295 - DNA, 19 bp, Homo sapiens
cagcccagccatttgagat

SEQ ID NO: 4296 - DNA, 19 bp, Homo sapiens
tcagcccagccatttgaga

SEQ ID NO: 4297 - DNA, 19 bp, Homo sapiens
gatgggaaagccgccctca

SEQ ID NO: 4298 - DNA, 19 bp, Homo sapiens
ttgaaagcagaacctctgg

SEQ ID NO: 4299 - DNA, 19 bp, Homo sapiens
ctttctcgggaatattcag

SEQ ID NO: 4300 - DNA, 19 bp, Homo sapiens
tgacaggcattttgaaaaa

SEQ ID NO: 4301 - DNA, 19 bp, Homo sapiens
ttgacaggcattttgaaaa

SEQ ID NO: 4302 - DNA, 19 bp, Homo sapiens
aattccaattttgagaatg

SEQ ID NO: 4303 - DNA, 19 bp, Homo sapiens
aaatgtcagctcttgttca

SEQ ID NO: 4304 - DNA, 19 bp, Homo sapiens
tgccagtttgaaaaacaaa

SEQ ID NO: 4305 - DNA, 19 bp, Homo sapiens
ttgacatgttgataaagaa

SEQ ID NO: 4306 - DNA, 19 bp, Homo sapiens
tgaagtagaccaacaaatc

SEQ ID NO: 4307 - DNA, 19 bp, Homo sapiens
cttcaggttccatcgtgca

SEQ ID NO: 4308 - DNA, 19 bp, Homo sapiens
atgttgataaagaaattaa

SEQ ID NO: 4309 - DNA, 19 bp, Homo sapiens
attcaaactgcctatattg

SEQ ID NO: 4310 - DNA, 19 bp, Homo sapiens
caagagcacacggtcttca

SEQ ID NO: 4311 - DNA, 19 bp, Homo sapiens
aaattccctgaagttgatg

SEQ ID NO: 4312 - DNA, 19 bp, Homo sapiens
aagtaagtgctaggttcaa

SEQ ID NO: 4313 - DNA, 19 bp, Homo sapiens
ttctgcacagaaatattca

SEQ ID NO: 4314 - DNA, 19 bp, Homo sapiens
gcttgctaacctctctgaa

SEQ ID NO: 4315 - DNA, 19 bp, Homo sapiens
gggacctaccaagagtgga

SEQ ID NO: 4316 - DNA, 19 bp, Homo sapiens
agttcaatgaatttattca

SEQ ID NO: 4317 - DNA, 19 bp, Homo sapiens
gattactatgaaaaattta

SEQ ID NO: 4318 - DNA, 19 bp, Homo sapiens
ttttaaaagaaatcttcaa

SEQ ID NO: 4319 - DNA, 19 bp, Homo sapiens
cgaggccaggccgcagccc

SEQ ID NO: 4320 - DNA, 19 bp, Homo sapiens
ccgaggccaggccgcagcc

SEQ ID NO: 4321 - DNA, 19 bp, Homo sapiens
aaccgtgcctgaatctcag

SEQ ID NO: 4322 - DNA, 19 bp, Homo sapiens
tcagctgacctcatcgaga

SEQ ID NO: 4323 - DNA, 19 bp, Homo sapiens
gctctgcagcttcatcctg

SEQ ID NO: 4324 - DNA, 19 bp, Homo sapiens
cagcacagaccatttcagc

SEQ ID NO: 4325 - DNA, 19 bp, Homo sapiens
ctggatgtaaccaccagca

SEQ ID NO: 4326 - DNA, 19 bp, Homo sapiens
catcctgaagaccagccag

SEQ ID NO: 4327 - DNA, 19 bp, Homo sapiens
actcaccctggacattcag

SEQ ID NO: 4328 - DNA, 19 bp, Homo sapiens
tcccggagccaaggctgga

SEQ ID NO: 4329 - DNA, 19 bp, Homo sapiens
ggaaccctctccctcacct

SEQ ID NO: 4330 - DNA, 19 bp, Homo sapiens
ctgggaggcatgatgctca

SEQ ID NO: 4331 - DNA, 19 bp, Homo sapiens
ttcaaatataatcggcaga

SEQ ID NO: 4332 - DNA, 19 bp, Homo sapiens
tcttccgttctgtaatggc

SEQ ID NO: 4333 - DNA, 19 bp, Homo sapiens
tgcaagaatattttgagag

SEQ ID NO: 4334 - DNA, 19 bp, Homo sapiens
ccagtttccggggaaacct

SEQ ID NO: 4335 - DNA, 19 bp, Homo sapiens
tctttttgggaagcaagga

SEQ ID NO: 4336 - DNA, 19 bp, Homo sapiens
aatggtcaagttcctgatg

SEQ ID NO: 4337 - DNA, 19 bp, Homo sapiens
gtctctgaactcagaagga

SEQ ID NO: 4338 - DNA, 19 bp, Homo sapiens
aacaaataaatggagtctt

SEQ ID NO: 4339 - DNA, 19 bp, Homo sapiens
ccagagccaggtcgagctt

SEQ ID NO: 4340 - DNA, 19 bp, Homo sapiens
tccatgtcccatttacaga

SEQ ID NO: 4341 - DNA, 19 bp, Homo sapiens
ttgattttaacaaaagtgg

SEQ ID NO: 4342 - DNA, 19 bp, Homo sapiens
ttgcaagcaagtctttcct

SEQ ID NO: 4343 - DNA, 19 bp, Homo sapiens
atttccataccccgtttgc

SEQ ID NO: 4344 - DNA, 19 bp, Homo sapiens
tattcttcttttccaattg

SEQ ID NO: 4345 - DNA, 19 bp, Homo sapiens
gtggcttcccatattgcca

SEQ ID NO: 4346 - DNA, 19 bp, Homo sapiens
cacattacatttggtctct

SEQ ID NO: 4347 - DNA, 19 bp, Human hepatitis C virus
ttttttttttttttttttt

SEQ ID NO: 4348 - DNA, 19 bp, Human hepatitis C virus
ttttttttttttttttttt

SEQ ID NO: 4349 - DNA, 19 bp, Homo sapiens
tgggaaagccgccctcaca

SEQ ID NO: 4350 - DNA, 19 bp, Homo sapiens
atgggaaagccgccctcac

SEQ ID NO: 4351 - DNA, 19 bp, Homo sapiens
gatgctgaacagtgagctg

SEQ ID NO: 4352 - DNA, 19 bp, Homo sapiens
tcataacagtactgtgagc

SEQ ID NO: 4353 - DNA, 19 bp, Homo sapiens
ctgagtgggtttatcaagg

SEQ ID NO: 4354 - DNA, 19 bp, Homo sapiens
gctgagtgggtttatcaag

SEQ ID NO: 4355 - DNA, 19 bp, Homo sapiens
ttgcaatgagctcatggct

SEQ ID NO: 4356 - DNA, 19 bp, Homo sapiens
gttgcaatgagctcatggc

SEQ ID NO: 4357 - DNA, 19 bp, Homo sapiens
gtaggaataaatggagaag

SEQ ID NO: 4358 - DNA, 19 bp, Homo sapiens
ttattgctgaatccaaaag

SEQ ID NO: 4359 - DNA, 19 bp, Homo sapiens
aaagccatcactgatgatc

SEQ ID NO: 4360 - DNA, 19 bp, Homo sapiens
caaagccatcactgatgat

SEQ ID NO: 4361 - DNA, 19 bp, Homo sapiens
tcacaaatcctttggctgt

SEQ ID NO: 4362 - DNA, 19 bp, Homo sapiens
caaaatagaagggaatctt

SEQ ID NO: 4363 - DNA, 19 bp, Homo sapiens
ctggtaactactttaaaca

SEQ ID NO: 4364 - DNA, 19 bp, Homo sapiens
gttcaatgaatttattcaa

SEQ ID NO: 4365 - DNA, 19 bp, Homo sapiens
atggcattttttgcaagtt

SEQ ID NO: 4366 - DNA, 19 bp, Homo sapiens
agattgatgggcagttcag

SEQ ID NO: 4367 - DNA, 19 bp, Homo sapiens
ctcaaagaatgactttttt

SEQ ID NO: 4368 - DNA, 19 bp, Homo sapiens
tctccagataaaaaactca

SEQ ID NO: 4369 - DNA, 19 bp, Homo sapiens
ctcagatcaaagttaattg

SEQ ID NO: 4370 - DNA, 19 bp, Homo sapiens
gagggtagtcataacagta

SEQ ID NO: 4371 - DNA, 19 bp, Homo sapiens
actgttgactcaggaaggc

SEQ ID NO: 4372 - DNA, 19 bp, Homo sapiens
tggccacatagcatggact

SEQ ID NO: 4373 - DNA, 19 bp, Homo sapiens
cagctgacctcatcgagat

SEQ ID NO: 4374 - DNA, 19 bp, Homo sapiens
tcagctgacctcatcgaga

SEQ ID NO: 4375 - DNA, 19 bp, Homo sapiens
acctgcaccaaagctggca

SEQ ID NO: 4376 - DNA, 19 bp, Homo sapiens
caccaaaaaccccaatggc

SEQ ID NO: 4377 - DNA, 19 bp, Homo sapiens
accagatgctgaacagtga

SEQ ID NO: 4378 - DNA, 19 bp, Homo sapiens
accacttacagctagaggg

SEQ ID NO: 4379 - DNA, 19 bp, Homo sapiens
gggcgacctaagttgtgac

SEQ ID NO: 4380 - DNA, 19 bp, Homo sapiens
tggctggtaacctaaaagg

SEQ ID NO: 4381 - DNA, 19 bp, Homo sapiens
ggtcctttatgattatgtc

SEQ ID NO: 4382 - DNA, 19 bp, Homo sapiens
ttcccaaaagcagtcagca

SEQ ID NO: 4383 - DNA, 19 bp, Homo sapiens
ttcaggtccatgcaagtca

SEQ ID NO: 4384 - DNA, 19 bp, Homo sapiens
tcttgaacacaaagtcagt

SEQ ID NO: 4385 - DNA, 19 bp, Homo sapiens
aaatgaaagtaaagatcat

SEQ ID NO: 4386 - DNA, 19 bp, Homo sapiens
gagtaaaccaaaacttggt

SEQ ID NO: 4387 - DNA, 19 bp, Homo sapiens
gagttactgaaaaagctgc

SEQ ID NO: 4388 - DNA, 19 bp, Homo sapiens
attggatatccaagatctg

SEQ ID NO: 4389 - DNA, 19 bp, Homo sapiens
ccatgacctccagctcctg

SEQ ID NO: 4390 - DNA, 19 bp, Homo sapiens
ctgaaatacaatgctctgg

SEQ ID NO: 4391 - DNA, 19 bp, Homo sapiens
gaaaaacttggaaacaacc

SEQ ID NO: 4392 - DNA, 19 bp, Homo sapiens
agaatccagatacaagaaa

SEQ ID NO: 4393 - DNA, 19 bp, Homo sapiens
cagcatgcctagtttctcc

SEQ ID NO: 4394 - DNA, 19 bp, Homo sapiens
tcaatatcaaaagcccagc

SEQ ID NO: 4395 - DNA, 19 bp, Homo sapiens
atatctggaaccttgaagt

SEQ ID NO: 4396 - DNA, 19 bp, Homo sapiens
ctgaactcagaaggatggc

SEQ ID NO: 4397 - DNA, 19 bp, Homo sapiens
cttccattctgaatatatt

SEQ ID NO: 4398 - DNA, 19 bp, Homo sapiens
gataaaagattactttgag

SEQ ID NO: 4399 - DNA, 19 bp, Homo sapiens
tcttcaatttattcttctt

SEQ ID NO: 4400 - DNA, 19 bp, Homo sapiens
atcttcaatttattcttct

SEQ ID NO: 4401 - DNA, 19 bp, Homo sapiens
ttcacataccagaattcca

SEQ ID NO: 4402 - DNA, 19 bp, Homo sapiens
tttttaaccagtcagatat

SEQ ID NO: 4403 - DNA, 19 bp, Homo sapiens
ctttttaaccagtcagata

SEQ ID NO: 4404 - DNA, 19 bp, Homo sapiens
ctaaattcccatggtcttg

SEQ ID NO: 4405 - DNA, 19 bp, Homo sapiens
actaaattcccatggtctt

SEQ ID NO: 4406 - DNA, 19 bp, Homo sapiens
tctttctcgggaatattca

SEQ ID NO: 4407 - DNA, 19 bp, Homo sapiens
gaagcacatatgaactgga

SEQ ID NO: 4408 - DNA, 19 bp, Homo sapiens
ttcctttaacaattcctga

SEQ ID NO: 4409 - DNA, 19 bp, Homo sapiens
gctgacatagggaatggaa

SEQ ID NO: 4410 - DNA, 19 bp, Homo sapiens
tattctatccaagattggg

SEQ ID NO: 4411 - DNA, 19 bp, Homo sapiens
ttctatccaagattgggct

SEQ ID NO: 4412 - DNA, 19 bp, Homo sapiens
tttgaaaaacaaagcagat

SEQ ID NO: 4413 - DNA, 19 bp, Homo sapiens
attttttgcaagttaaaga

SEQ ID NO: 4414 - DNA, 19 bp, Homo sapiens
gcatggcattatgatgaag

SEQ ID NO: 4415 - DNA, 19 bp, Homo sapiens
ttcagggtgtggagtttag

SEQ ID NO: 4416 - DNA, 19 bp, Homo sapiens
tttcttaaacattccttta

SEQ ID NO: 4417 - DNA, 19 bp, Homo sapiens
ttccctccattaagttctc

SEQ ID NO: 4418 - DNA, 19 bp, Homo sapiens
ttccaatgaccaagaaaag

SEQ ID NO: 4419 - DNA, 19 bp, Homo sapiens
gcttactggacgaactctg

SEQ ID NO: 4420 - DNA, 19 bp, Homo sapiens
caaattcctggatacactg

SEQ ID NO: 4421 - DNA, 19 bp, Homo sapiens
acaagaatacgtctacact

SEQ ID NO: 4422 - DNA, 19 bp, Homo sapiens
acctcggaacaatcctcag

SEQ ID NO: 4423 - DNA, 19 bp, Homo sapiens
gacctgcgcaacgagatca

SEQ ID NO: 4424 - DNA, 19 bp, Homo sapiens
ccatgatctacatttgttt

SEQ ID NO: 4425 - DNA, 19 bp, Homo sapiens
caaaaacattttcaacttc

SEQ ID NO: 4426 - DNA, 19 bp, Homo sapiens
ctttaagttcagcatcttt

SEQ ID NO: 4427 - DNA, 19 bp, Homo sapiens
cagatttgaggattccatc

SEQ ID NO: 4428 - DNA, 19 bp, Homo sapiens
caatcacaagtcgattccc

SEQ ID NO: 4429 - DNA, 19 bp, Homo sapiens
gaagtgtcagtggcaaaaa

SEQ ID NO: 4430 - DNA, 19 bp, Homo sapiens
catggcattatgatgaaga

SEQ ID NO: 4431 - DNA, 19 bp, Homo sapiens
cattatggaggcccatgta

SEQ ID NO: 4432 - DNA, 19 bp, Homo sapiens
caaaatcaactttaatgaa

SEQ ID NO: 4433 - DNA, 19 bp, Homo sapiens
tcaacacaatcttcaatga

SEQ ID NO: 4434 - DNA, 19 bp, Homo sapiens
ctccccaggacctttcaaa

SEQ ID NO: 4435 - DNA, 19 bp, Homo sapiens
gctccccaggacctttcaa

SEQ ID NO: 4436 - DNA, 19 bp, Homo sapiens
agctccccaggacctttca

SEQ ID NO: 4437 - DNA, 19 bp, Homo sapiens
ctgtttctgagtcccagtg

SEQ ID NO: 4438 - DNA, 19 bp, Homo sapiens
actgtttctgagtcccagt

SEQ ID NO: 4439 - DNA, 19 bp, Homo sapiens
gatgatgccaaaatcaact

SEQ ID NO: 4440 - DNA, 19 bp, Homo sapiens
agatgatgccaaaatcaac

SEQ ID NO: 4441 - DNA, 19 bp, Homo sapiens
actcagaaggatggcattt

SEQ ID NO: 4442 - DNA, 19 bp, Homo sapiens
ttggttacaggaggcttta

SEQ ID NO: 4443 - DNA, 19 bp, Homo sapiens
ttttcttttcagcccagcc

SEQ ID NO: 4444 - DNA, 19 bp, Homo sapiens
attttcaagcaaatgcaca

SEQ ID NO: 4445 - DNA, 19 bp, Homo sapiens
atgcgtctaccttacacaa

SEQ ID NO: 4446 - DNA, 19 bp, Homo sapiens
ggaagctgaagtttatcat

SEQ ID NO: 4447 - DNA, 19 bp, Homo sapiens
cagagctatcactgggaag

SEQ ID NO: 4448 - DNA, 19 bp, Homo sapiens
gagcttactggacgaactc

SEQ ID NO: 4449 - DNA, 19 bp, Homo sapiens
cagcctccccagccgtagg

SEQ ID NO: 4450 - DNA, 19 bp, Homo sapiens
aaactgttaatttacagct

SEQ ID NO: 4451 - DNA, 19 bp, Homo sapiens
agtttccggggaaacctgg

SEQ ID NO: 4452 - DNA, 19 bp, Homo sapiens
tacagtattctgaaaatcc

SEQ ID NO: 4453 - DNA, 19 bp, Homo sapiens
aatgagctcatggcttcag

SEQ ID NO: 4454 - DNA, 19 bp, Homo sapiens
attttgagaggaatcgaca

SEQ ID NO: 4455 - DNA, 19 bp, Homo sapiens
aacacatgaatcacaaatt

SEQ ID NO: 4456 - DNA, 19 bp, Homo sapiens
tcaaaacgagcttcaggaa

SEQ ID NO: 4457 - DNA, 19 bp, Homo sapiens
aacttgtacaactggtccg

SEQ ID NO: 4458 - DNA, 19 bp, Homo sapiens
tcatcaattggttacagga

SEQ ID NO: 4459 - DNA, 19 bp, Homo sapiens
tctgcagaacaatgctgag

SEQ ID NO: 4460 - DNA, 19 bp, Homo sapiens
aattgactttgtagaaatg

SEQ ID NO: 4461 - DNA, 19 bp, Homo sapiens
ccatgcaagtcagcccagt

SEQ ID NO: 4462 - DNA, 19 bp, Homo sapiens
aaactgcctatattgataa

SEQ ID NO: 4463 - DNA, 19 bp, Homo sapiens
ctggacttctcttcaaaac

SEQ ID NO: 4464 - DNA, 19 bp, Homo sapiens
tctgggtgtcgacagcaaa

SEQ ID NO: 4465 - DNA, 19 bp, Homo sapiens
ttctgggtgtcgacagcaa

SEQ ID NO: 4466 - DNA, 19 bp, Homo sapiens
agtcaagattgatgggcag

SEQ ID NO: 4467 - DNA, 19 bp, Homo sapiens
ggaggctttaagttcagca

SEQ ID NO: 4468 - DNA, 19 bp, Homo sapiens
ctgtatagcaaattcctgt

SEQ ID NO: 4469 - DNA, 19 bp, Homo sapiens
catggacttcttctggaaa

SEQ ID NO: 4470 - DNA, 19 bp, Homo sapiens
tgcccagcaagcaagttgg

SEQ ID NO: 4471 - DNA, 19 bp, Homo sapiens
catccttaacaccttccac

SEQ ID NO: 4472 - DNA, 19 bp, Homo sapiens
ttcactgttcctgaaatca

SEQ ID NO: 4473 - DNA, 19 bp, Homo sapiens
caaaaacattttcaacttc

SEQ ID NO: 4474 - DNA, 19 bp, Homo sapiens
attcataatcccaactctc

SEQ ID NO: 4475 - DNA, 19 bp, Homo sapiens
tgcctttgtgtacaccaaa

SEQ ID NO: 4476 - DNA, 19 bp, Homo sapiens
ggtaacctaaaaggagcct

SEQ ID NO: 4477 - DNA, 19 bp, Homo sapiens
attgaagtacctacttttg

SEQ ID NO: 4478 - DNA, 19 bp, Homo sapiens
aattgaagtacctactttt

SEQ ID NO: 4479 - DNA, 19 bp, Homo sapiens
aaatccaatctcctctttt

SEQ ID NO: 4480 - DNA, 19 bp, Homo sapiens
gtctgtgggattccatctg

SEQ ID NO: 4481 - DNA, 19 bp, Homo sapiens
tcataagttcaatgaattt

SEQ ID NO: 4482 - DNA, 19 bp, Homo sapiens
ccattgaccagatgctgaa

SEQ ID NO: 4483 - DNA, 19 bp, Homo sapiens
tggaaatgggcctgcccca

SEQ ID NO: 4484 - DNA, 19 bp, Homo sapiens
aatcacaactcctccactg

SEQ ID NO: 4485 - DNA, 19 bp, Homo sapiens
caaaactaccacacatttc

SEQ ID NO: 4486 - DNA, 19 bp, Homo sapiens
tttgagaggaatcgacaaa

SEQ ID NO: 4487 - DNA, 19 bp, Homo sapiens
catcaattggttacaggag

SEQ ID NO: 4488 - DNA, 19 bp, Homo sapiens
agtccttcatgtccctaga

SEQ ID NO: 4489 - DNA, 19 bp, Homo sapiens
ggcattttgaaaaaaacag

SEQ ID NO: 4490 - DNA, 19 bp, Homo sapiens
aactctcaaaccctaagat

SEQ ID NO: 4491 - DNA, 19 bp, Homo sapiens
ggacattcctctagcgaga

SEQ ID NO: 4492 - DNA, 19 bp, Homo sapiens
aatgaatacagccaggact

SEQ ID NO: 4493 - DNA, 19 bp, Homo sapiens
actttgtagaaatgaaagt

SEQ ID NO: 4494 - DNA, 19 bp, Homo sapiens
ttgaaggacttcaggaatg

SEQ ID NO: 4495 - DNA, 19 bp, Homo sapiens
gagtaaaccaaaacttggt

SEQ ID NO: 4496 - DNA, 19 bp, Homo sapiens
cctttaacaattcctgaaa

SEQ ID NO: 4497 - DNA, 19 bp, Homo sapiens
tcattctgggtctttccag

SEQ ID NO: 4498 - DNA, 19 bp, Homo sapiens
tagaattacagaaaatgat

SEQ ID NO: 4499 - DNA, 19 bp, Homo sapiens
cgtaggcaccgtgggcatg

SEQ ID NO: 4500 - DNA, 19 bp, Homo sapiens
ttgatgatgctgtcaagaa

SEQ ID NO: 4501 - DNA, 19 bp, Homo sapiens
cagaattccagcttcccca

SEQ ID NO: 4502 - DNA, 19 bp, Homo sapiens
ttgaggctattgatgttag

SEQ ID NO: 4503 - DNA, 19 bp, Homo sapiens
attgaggctattgatgtta

SEQ ID NO: 4504 - DNA, 19 bp, Homo sapiens
cattgaggctattgatgtt

SEQ ID NO: 4505 - DNA, 19 bp, Homo sapiens
tctccatctgcgctaccag

SEQ ID NO: 4506 - DNA, 19 bp, Homo sapiens
tcatctcctttcttcatct

SEQ ID NO: 4507 - DNA, 19 bp, Homo sapiens
cagatatatatctcaggga

SEQ ID NO: 4508 - DNA, 19 bp, Homo sapiens
tcaggctcttcagaaagct

SEQ ID NO: 4509 - DNA, 19 bp, Homo sapiens
tgtcaagataaacaatcag

SEQ ID NO: 4510 - DNA, 19 bp, Homo sapiens
gaagtagtactgcatcttg

SEQ ID NO: 4511 - DNA, 19 bp, Homo sapiens
ctgagtcccagtgcccagc

SEQ ID NO: 4512 - DNA, 19 bp, Homo sapiens
cagcaagtacctgagaacg

SEQ ID NO: 4513 - DNA, 19 bp, Homo sapiens
actcagatcaaagttaatt

SEQ ID NO: 4514 - DNA, 19 bp, Homo sapiens
agcacagtacgaaaaacca

SEQ ID NO: 4515 - DNA, 19 bp, Homo sapiens
tgtccctagaaatctcaag

SEQ ID NO: 4516 - DNA, 19 bp, Homo sapiens
atgtccctagaaatctcaa

SEQ ID NO: 4517 - DNA, 19 bp, Homo sapiens
gatggaaccctctccctca

SEQ ID NO: 4518 - DNA, 19 bp, Homo sapiens
aggaaactcagatcaaagt

SEQ ID NO: 4519 - DNA, 19 bp, Homo sapiens
agcagccagtggcaccact

SEQ ID NO: 4520 - DNA, 19 bp, Homo sapiens
tcagccaggtttatagcac

SEQ ID NO: 4521 - DNA, 19 bp, Homo sapiens
aatttctgattaccaccag

SEQ ID NO: 4522 - DNA, 19 bp, Homo sapiens
tgttttttggaaatgccat

SEQ ID NO: 4523 - DNA, 19 bp, Homo sapiens
ctttgacaggcattttgaa

SEQ ID NO: 4524 - DNA, 19 bp, Homo sapiens
tcgatgcacatacaaatgg

SEQ ID NO: 4525 - DNA, 19 bp, Homo sapiens
ttgatgttagagtgctttt

SEQ ID NO: 4526 - DNA, 19 bp, Homo sapiens
tgtcctacaacaagttaag

SEQ ID NO: 4527 - DNA, 19 bp, Homo sapiens
atgtcctacaacaagttaa

SEQ ID NO: 4528 - DNA, 19 bp, Homo sapiens
agcatctttggctcacatg

SEQ ID NO: 4529 - DNA, 19 bp, Homo sapiens
atttatcaaaagaagccca

SEQ ID NO: 4530 - DNA, 19 bp, Homo sapiens
ttttggcaagctatacagt

SEQ ID NO: 4531 - DNA, 19 bp, Homo sapiens
tcaattgggagagacaagt

SEQ ID NO: 4532 - DNA, 19 bp, Homo sapiens
tgctttgtgagtttatcag

SEQ ID NO: 4533 - DNA, 19 bp, Homo sapiens
cagtcatgtagaaaaactt

SEQ ID NO: 4534 - DNA, 19 bp, Homo sapiens
tgtactggaaaacgtacag

SEQ ID NO: 4535 - DNA, 19 bp, Homo sapiens
aatattgatcaatttgtaa

SEQ ID NO: 4536 - DNA, 19 bp, Homo sapiens
gtttgaaaaacaaagcaga

SEQ ID NO: 4537 - DNA, 19 bp, Homo sapiens
tttcatttgaaagaataaa

SEQ ID NO: 4538 - DNA, 19 bp, Homo sapiens
atttcaagcaagaacttaa

SEQ ID NO: 4539 - DNA, 19 bp, Homo sapiens
attggcgtggagcttactg

SEQ ID NO: 4540 - DNA, 19 bp, Homo sapiens
ttttgctggagaagccaca

SEQ ID NO: 4541 - DNA, 19 bp, Homo sapiens
ctttgcactatgttcataa

SEQ ID NO: 4542 - DNA, 19 bp, Homo sapiens
aaacacctaagagtaaacc

SEQ ID NO: 4543 - DNA, 19 bp, Homo sapiens
aaatgctgacatagggaat

SEQ ID NO: 4544 - DNA, 19 bp, Homo sapiens
gaaatattatgaacttgaa

SEQ ID NO: 4545 - DNA, 19 bp, Homo sapiens
tttcctaaagctggatgta

SEQ ID NO: 4546 - DNA, 19 bp, Homo sapiens
caggtccatgcaagtcagc

SEQ ID NO: 4547 - DNA, 19 bp, Homo sapiens
ccagcttccccacatctca

SEQ ID NO: 4548 - DNA, 19 bp, Homo sapiens
tcttcgtgtttcaactgcc

SEQ ID NO: 4549 - DNA, 19 bp, Homo sapiens
caagtaagtgctaggttca

SEQ ID NO: 4550 - DNA, 19 bp, Homo sapiens
ccaacacttacttgaattc

SEQ ID NO: 4551 - DNA, 19 bp, Homo sapiens
tcagaaagctaccttccag

SEQ ID NO: 4552 - DNA, 19 bp, Homo sapiens
atggacttcttctggaaaa

SEQ ID NO: 4553 - DNA, 19 bp, Homo sapiens
ctcatctcctttcttcatc

SEQ ID NO: 4554 - DNA, 19 bp, Homo sapiens
cttttctaaacttgaaatt

SEQ ID NO: 4555 - DNA, 19 bp, Homo sapiens
ttatgaacttgaagaaaag

SEQ ID NO: 4556 - DNA, 19 bp, Homo sapiens
ttttcacattagatgcaaa

SEQ ID NO: 4557 - DNA, 19 bp, Homo sapiens
aaaattgatgatatctgga

SEQ ID NO: 4558 - DNA, 19 bp, Homo sapiens
aaaagggtcatggaaatgg

SEQ ID NO: 4559 - DNA, 19 bp, Homo sapiens
ctcaattttgattttcaag

SEQ ID NO: 4560 - DNA, 19 bp, Homo sapiens
attccctccattaagttct

SEQ ID NO: 4561 - DNA, 19 bp, Homo sapiens
tttcaagcaagaacttaat

SEQ ID NO: 4562 - DNA, 19 bp, Homo sapiens
atcagttcagataaacttc

SEQ ID NO: 4563 - DNA, 19 bp, Homo sapiens
aattccctgaagttgatgt

SEQ ID NO: 4564 - DNA, 19 bp, Homo sapiens
gctttctcttccacatttc

SEQ ID NO: 4565 - DNA, 19 bp, Homo sapiens
cccatttacagatcttcag

SEQ ID NO: 4566 - DNA, 19 bp, Homo sapiens
tcccatttacagatcttca

SEQ ID NO: 4567 - DNA, 19 bp, Homo sapiens
tttgaggattccatcagtt

SEQ ID NO: 4568 - DNA, 19 bp, Homo sapiens
tctggctccctcaactttt

SEQ ID NO: 4569 - DNA, 19 bp, Homo sapiens
gtttattgaaaatattgat

SEQ ID NO: 4570 - DNA, 19 bp, Homo sapiens
aatattattgatgaaatca

SEQ ID NO: 4571 - DNA, 19 bp, Homo sapiens
gcaagaacttaatggaaat

SEQ ID NO: 4572 - DNA, 19 bp, Homo sapiens
catcacactgaataccaat

SEQ ID NO: 4573 - DNA, 19 bp, Homo sapiens
caagagcttatgggatttc

SEQ ID NO: 4574 - DNA, 19 bp, Homo sapiens
attactttgagaaattagt

SEQ ID NO: 4575 - DNA, 19 bp, Homo sapiens
acttgacttcagagaaata

SEQ ID NO: 4576 - DNA, 19 bp, Homo sapiens
gtcttcagtgaagctgcag

SEQ ID NO: 4577 - DNA, 19 bp, Homo sapiens
agcctcacctcttactttt

SEQ ID NO: 4578 - DNA, 19 bp, Homo sapiens
aagtagctgagaaaatcaa

SEQ ID NO: 4579 - DNA, 19 bp, Homo sapiens
ttttcacattagatgcaaa

SEQ ID NO: 4580 - DNA, 19 bp, Homo sapiens
ggtggactcttgctgctaa

SEQ ID NO: 4581 - DNA, 19 bp, Homo sapiens
ttctcaattttgattttca

SEQ ID NO: 4582 - DNA, 19 bp, Homo sapiens
ttagccacagctctgtctc

SEQ ID NO: 4583 - DNA, 19 bp, Homo sapiens
tcaagaagcttaatgaatt

SEQ ID NO: 4584 - DNA, 19 bp, Homo sapiens
aaaacgagcttcaggaagc

SEQ ID NO: 4585 - DNA, 19 bp, Homo sapiens
atgtcctacaacaagttaa

SEQ ID NO: 4586 - DNA, 19 bp, Homo sapiens
aatcctttgacaggcattt

SEQ ID NO: 4587 - DNA, 19 bp, Homo sapiens
tgaaattcaatcacaagtc

SEQ ID NO: 4588 - DNA, 19 bp, Homo sapiens
gttctcaattttgattttc

SEQ ID NO: 4589 - DNA, 19 bp, Homo sapiens
ttcaggaactattgctagt

SEQ ID NO: 4590 - DNA, 19 bp, Homo sapiens
atgatttccctgaccttgg

SEQ ID NO: 4591 - DNA, 19 bp, Homo sapiens
ttgaagtaaaagaaaattt

SEQ ID NO: 4592 - DNA, 19 bp, Homo sapiens
caaatctggatttcttaaa

SEQ ID NO: 4593 - DNA, 19 bp, Homo sapiens
caagggttcactgttcctg

SEQ ID NO: 4594 - DNA, 19 bp, Homo sapiens
gattctcagatgagggaac

SEQ ID NO: 4595 - DNA, 19 bp, Homo sapiens
cttgaacacaaagtcagtg

SEQ ID NO: 4596 - DNA, 19 bp, Homo sapiens
tcttgaacacaaagtcagt

SEQ ID NO: 4597 - DNA, 19 bp, Homo sapiens
actgttgactcaggaaggc

SEQ ID NO: 4598 - DNA, 19 bp, Homo sapiens
ggaagcttctcaagagtta

SEQ ID NO: 4599 - DNA, 19 bp, Homo sapiens
aaatttctctgctggaaac

SEQ ID NO: 4600 - DNA, 19 bp, Homo sapiens
atctgcagaacaatgctga

SEQ ID NO: 4601 - DNA, 19 bp, Homo sapiens
ggcagcttctggcttgcta

SEQ ID NO: 4602 - DNA, 19 bp, Homo sapiens
aactgttgactcaggaagg

SEQ ID NO: 4603 - DNA, 19 bp, Homo sapiens
agctgccagtccttcatgt

SEQ ID NO: 4604 - DNA, 19 bp, Homo sapiens
cattaatcctgccatcatt

SEQ ID NO: 4605 - DNA, 19 bp, Homo sapiens
ccatttgagatcacggcat

SEQ ID NO: 4606 - DNA, 19 bp, Homo sapiens
ttcgttttccattaaggtt

SEQ ID NO: 4607 - DNA, 19 bp, Homo sapiens
ggaagtggccctgaatgct

SEQ ID NO: 4608 - DNA, 19 bp, Homo sapiens
agggaaagagaagattgca

SEQ ID NO: 4609 - DNA, 19 bp, Homo sapiens
gagaacttactatcatcct

SEQ ID NO: 4610 - DNA, 19 bp, Homo sapiens
tcaatgaatttattcaaaa

SEQ ID NO: 4611 - DNA, 19 bp, Homo sapiens
tcttttcagcccagccatt

SEQ ID NO: 4612 - DNA, 19 bp, Homo sapiens
gctgactttaaaatctgac

SEQ ID NO: 4613 - DNA, 19 bp, Homo sapiens
gggatttcctaaagctgga

SEQ ID NO: 4614 - DNA, 19 bp, Homo sapiens
ccagtttccagggactcaa

SEQ ID NO: 4615 - DNA, 19 bp, Homo sapiens
aagtcgattcccagcatgt

SEQ ID NO: 4616 - DNA, 19 bp, Homo sapiens
tcagatggaaaaatgaagt

SEQ ID NO: 4617 - DNA, 19 bp, Homo sapiens
gaaagtccataatggttca

SEQ ID NO: 4618 - DNA, 19 bp, Homo sapiens
ggaagaagaggcagcttct

SEQ ID NO: 4619 - DNA, 19 bp, Homo sapiens
atctaaatgcagtagccaa

SEQ ID NO: 4620 - DNA, 19 bp, Homo sapiens
attgataaaaccatacagt

SEQ ID NO: 4621 - DNA, 19 bp, Homo sapiens
tattgataaaaccatacag

SEQ ID NO: 4622 - DNA, 19 bp, Homo sapiens
gggaatctgatgaggaaac

SEQ ID NO: 4623 - DNA, 19 bp, Homo sapiens
ttgagttgcccaccatcat

SEQ ID NO: 4624 - DNA, 19 bp, Homo sapiens
caagatcgcagactttgag

SEQ ID NO: 4625 - DNA, 19 bp, Homo sapiens
aacagaaacaatgcattag

SEQ ID NO: 4626 - DNA, 19 bp, Homo sapiens
ccaagaaaaggcacacctt

SEQ ID NO: 4627 - DNA, 19 bp, Homo sapiens
ccctaacagatttgaggat

SEQ ID NO: 4628 - DNA, 19 bp, Homo sapiens
aaacaaacacaggcattcc

SEQ ID NO: 4629 - DNA, 19 bp, Homo sapiens
gaaatactgttttcctatt

SEQ ID NO: 4630 - DNA, 19 bp, Homo sapiens
ataaactgcaagatttttc

SEQ ID NO: 4631 - DNA, 19 bp, Homo sapiens
gctttccaatgaccaagaa

SEQ ID NO: 4632 - DNA, 19 bp, Homo sapiens
ctgtgctttgtgagtttat

SEQ ID NO: 4633 - DNA, 19 bp, Homo sapiens
gaatttgaaagttcgtttt

SEQ ID NO: 4634 - DNA, 19 bp, Homo sapiens
aggaagtggccctgaatgc

SEQ ID NO: 4635 - DNA, 19 bp, Homo sapiens
tgttgaaagatttatcaaa

SEQ ID NO: 4636 - DNA, 19 bp, Homo sapiens
gacaagaaaaaggggattg

SEQ ID NO: 4637 - DNA, 19 bp, Homo sapiens
ctgagaacttcatcatttg

SEQ ID NO: 4638 - DNA, 19 bp, Homo sapiens
ctggacttctctagtcagg

SEQ ID NO: 4639 - DNA, 19 bp, Homo sapiens
tgaatctggctccctcaac

SEQ ID NO: 4640 - DNA, 19 bp, Homo sapiens
agaatccagatacaagaaa

SEQ ID NO: 4641 - DNA, 19 bp, Homo sapiens
cagaatccagatacaagaa

SEQ ID NO: 4642 - DNA, 19 bp, Homo sapiens
ggacagtgaaatattatga

SEQ ID NO: 4643 - DNA, 19 bp, Homo sapiens
ctggatgtaaccaccagca

SEQ ID NO: 4644 - DNA, 19 bp, Homo sapiens
atgaagcttgctccaggag

SEQ ID NO: 4645 - DNA, 19 bp, Homo sapiens
ctgcgctaccagaaagaca

SEQ ID NO: 4646 - DNA, 19 bp, Homo sapiens
tttgagttgcccaccatca

SEQ ID NO: 4647 - DNA, 19 bp, Homo sapiens
gttgaccacaagcttagct

SEQ ID NO: 4648 - DNA, 19 bp, Homo sapiens
caaagctggcaccagggct

SEQ ID NO: 4649 - DNA, 19 bp, Homo sapiens
gcttcaggaagcttctcaa

SEQ ID NO: 4650 - DNA, 19 bp, Homo sapiens
aggaaggccaagccagttt

SEQ ID NO: 4651 - DNA, 19 bp, Homo sapiens
atgattatgtcaacaagta

SEQ ID NO: 4652 - DNA, 19 bp, Homo sapiens
ctgacatcttaggcactga

SEQ ID NO: 4653 - DNA, 19 bp, Homo sapiens
gaactcagaaggatggcat

SEQ ID NO: 4654 - DNA, 19 bp, Homo sapiens
ttctcaattttgattttca

SEQ ID NO: 4655 - DNA, 19 bp, Homo sapiens
ttttctaaatggaacttct

SEQ ID NO: 4656 - DNA, 19 bp, Homo sapiens
ggatctaaatgcagtagcc

SEQ ID NO: 4657 - DNA, 19 bp, Homo sapiens
atttcttaaacattccttt

SEQ ID NO: 4658 - DNA, 19 bp, Homo sapiens
gaatctggctccctcaact

SEQ ID NO: 4659 - DNA, 19 bp, Homo sapiens
tcattctgggtctttccag

SEQ ID NO: 4660 - DNA, 19 bp, Homo sapiens
atagcatggacttcttctg

SEQ ID NO: 4661 - DNA, 19 bp, human hepatitis C virus
ttttttttttttttttttt

SEQ ID NO: 4662 - DNA, 19 bp, Homo sapiens
cttctggcttgctaacctc

SEQ ID NO: 4663 - DNA, 19 bp, Homo sapiens
cacggagttactgaaaaag

SEQ ID NO: 4664 - DNA, 19 bp, Homo sapiens
aaggcatctccacctcagc

SEQ ID NO: 4665 - DNA, 19 bp, Homo sapiens
tccaagatgagatcaacac

SEQ ID NO: 4666 - DNA, 19 bp, Homo sapiens
gttgagaagccccaagaat

SEQ ID NO: 4667 - DNA, 19 bp, Homo sapiens
aaattctcttttcttttca

SEQ ID NO: 4668 - DNA, 19 bp, Homo sapiens
tgaaagtcaagcatctgat

SEQ ID NO: 4669 - DNA, 19 bp, Homo sapiens
catccttaacaccttccac

SEQ ID NO: 4670 - DNA, 19 bp, Homo sapiens
tgtaccataagccatattt

SEQ ID NO: 4671 - DNA, 19 bp, Homo sapiens
ttgatgttagagtgctttt

SEQ ID NO: 4672 - DNA, 19 bp, Homo sapiens
tctgcacagaaatattcag

SEQ ID NO: 4673 - DNA, 19 bp, Homo sapiens
taaatggagtctttattgt

SEQ ID NO: 4674 - DNA, 19 bp, Homo sapiens
ataaatggagtctttattg

SEQ ID NO: 4675 - DNA, 19 bp, Homo sapiens
atattgtcagtgcctctaa

SEQ ID NO: 4676 - DNA, 19 bp, Homo sapiens
attactatgaaaaatttat

SEQ ID NO: 4677 - DNA, 19 bp, Homo sapiens
gttattttgctaaacttgg

SEQ ID NO: 4678 - DNA, 19 bp, Homo sapiens
tcatcctctaattttttaa

SEQ ID NO: 4679 - DNA, 19 bp, Homo sapiens
tttcatttgaaagaataaa

SEQ ID NO: 4680 - DNA, 19 bp, Homo sapiens
gaataccaatgctgaactt

SEQ ID NO: 4681 - DNA, 19 bp, Homo sapiens
ctgagagaagtgtcttcaa

SEQ ID NO: 4682 - DNA, 19 bp, Homo sapiens
atatctggaaccttgaagt

SEQ ID NO: 4683 - DNA, 19 bp, Homo sapiens
attccctgaagttgatgtg

SEQ ID NO: 4684 - DNA, 19 bp, Homo sapiens
atttttattcctgccatgg

SEQ ID NO: 4685 - DNA, 19 bp, Homo sapiens
aaaattcaaactgcctata

SEQ ID NO: 4686 - DNA, 19 bp, Homo sapiens
atttgtaagaaaatacaga

SEQ ID NO: 4687 - DNA, 19 bp, Homo sapiens
cagcatgcctagtttctcc

SEQ ID NO: 4688 - DNA, 19 bp, Homo sapiens
tctcctttcttcatcttca

SEQ ID NO: 4689 - DNA, 19 bp, Homo sapiens
ttggtagagcaagggttca

SEQ ID NO: 4690 - DNA, 19 bp, Homo sapiens
cctcctacagtggtggcaa

SEQ ID NO: 4691 - DNA, 19 bp, Homo sapiens
tgaaaacgacaaagcaatc

SEQ ID NO: 4692 - DNA, 19 bp, Homo sapiens
acttttctaaacttgaaat

SEQ ID NO: 4693 - DNA, 19 bp, Homo sapiens
tcagcccagccatttgaga

SEQ ID NO: 4694 - DNA, 19 bp, Homo sapiens
gctggatgtaaccaccagc

SEQ ID NO: 4695 - DNA, 19 bp, Homo sapiens
catcagaaccattgaccag

SEQ ID NO: 4696 - DNA, 19 bp, Homo sapiens
actcaatggtgaaattcag

SEQ ID NO: 4697 - DNA, 19 bp, Homo sapiens
cctcacttcctttggactg

SEQ ID NO: 4698 - DNA, 19 bp, Homo sapiens
tgcaaacttgacttcagag

SEQ ID NO: 4699 - DNA, 19 bp, Homo sapiens
atgacgttcttgagcatgt

SEQ ID NO: 4700 - DNA, 19 bp, Homo sapiens
actggacttctctagtcag

SEQ ID NO: 4701 - DNA, 19 bp, Homo sapiens
atgcctacgttccatgtcc

SEQ ID NO: 4702 - DNA, 19 bp, Homo sapiens
gagaagtgtcttcaaagct

SEQ ID NO: 4703 - DNA, 19 bp, Homo sapiens
gagatcaacacaatcttca

SEQ ID NO: 4704 - DNA, 19 bp, Homo sapiens
ctgaattactgcacctcag

SEQ ID NO: 4705 - DNA, 19 bp, Homo sapiens
ttggtagagcaagggttca

SEQ ID NO: 4706 - DNA, 19 bp, Homo sapiens
tggcactgtttggagaagg

SEQ ID NO: 4707 - DNA, 19 bp, Homo sapiens
gcaagtcagcccagttcct

SEQ ID NO: 4708 - DNA, 19 bp, Homo sapiens
atgaaaccaatgacaaaat

SEQ ID NO: 4709 - DNA, 19 bp, Homo sapiens
tgaaatacaatgctctgga

SEQ ID NO: 4710 - DNA, 19 bp, Homo sapiens
gaaataccaagtcaaaacc

SEQ ID NO: 4711 - DNA, 19 bp, Homo sapiens
tgaaaaagctgcaatcaac

SEQ ID NO: 4712 - DNA, 19 bp, Homo sapiens
aactgcttctccaaatgga

SEQ ID NO: 4713 - DNA, 19 bp, Homo sapiens
agaattcataatcccaact

SEQ ID NO: 4714 - DNA, 19 bp, Homo sapiens
caaaacctactgtctcttc

SEQ ID NO: 4715 - DNA, 19 bp, Homo sapiens
cttcacataccagaattcc

SEQ ID NO: 4716 - DNA, 19 bp, Homo sapiens
aacaaacacaggcattcca

SEQ ID NO: 4717 - DNA, 19 bp, Homo sapiens
cttcatgtccctagaaatc

SEQ ID NO: 4718 - DNA, 19 bp, Homo sapiens
cttcagcctgctttctgga

SEQ ID NO: 4719 - DNA, 19 bp, Homo sapiens
cattagagctgccagtcct

SEQ ID NO: 4720 - DNA, 19 bp, Homo sapiens
tgaagatgacgacttttct

SEQ ID NO: 4721 - DNA, 19 bp, Homo sapiens
tgccagtttgaaaaacaaa

SEQ ID NO: 4722 - DNA, 19 bp, Homo sapiens
aatgtcagctcttgttcag

SEQ ID NO: 4723 - DNA, 19 bp, Homo sapiens
tcatttgccctcaacctac

SEQ ID NO: 4724 - DNA, 19 bp, Homo sapiens
gggaactgttgaaagattt

SEQ ID NO: 4725 - DNA, 19 bp, Homo sapiens
caggagaacttactatcat

SEQ ID NO: 4726 - DNA, 19 bp, Homo sapiens
aactcctccactgaaagat

SEQ ID NO: 4727 - DNA, 19 bp, Homo sapiens
acttccgtttaccagaaat

SEQ ID NO: 4728 - DNA, 19 bp, Homo sapiens
cagagctttctgccactgc

SEQ ID NO: 4729 - DNA, 19 bp, Homo sapiens
aaattcaaactgcctatat

SEQ ID NO: 4730 - DNA, 19 bp, Homo sapiens
aaatacttccacaaattga

SEQ ID NO: 4731 - DNA, 19 bp, Homo sapiens
attgaacatccccaaactg

SEQ ID NO: 4732 - DNA, 19 bp, Homo sapiens
tttcaactgcctttgtgta

SEQ ID NO: 4733 - DNA, 19 bp, Homo sapiens
ttattgctgaatccaaaag

SEQ ID NO: 4734 - DNA, 19 bp, Homo sapiens
ttttcaagcaaatgcacaa

SEQ ID NO: 4735 - DNA, 19 bp, Homo sapiens
aaaagaaaattttgctgga

SEQ ID NO: 4736 - DNA, 19 bp, Homo sapiens
tgaagtagaccaacaaatc

SEQ ID NO: 4737 - DNA, 19 bp, Homo sapiens
aaactaaatgatctaaatt

SEQ ID NO: 4738 - DNA, 19 bp, Homo sapiens
gcaatttctgcacagaaat

SEQ ID NO: 4739 - DNA, 19 bp, Homo sapiens
aaagccattcagtctctca

SEQ ID NO: 4740 - DNA, 19 bp, Homo sapiens
aattccatatgaaagtcaa

SEQ ID NO: 4741 - DNA, 19 bp, Homo sapiens
agaatattttgatccaagt

SEQ ID NO: 4742 - DNA, 19 bp, Homo sapiens
aaatctggatttcttaaac

SEQ ID NO: 4743 - DNA, 19 bp, Homo sapiens
aaataaatggagtctttat

SEQ ID NO: 4744 - DNA, 19 bp, Homo sapiens
ctcagttaactgtgtcccg

SEQ ID NO: 4745 - DNA, 19 bp, Homo sapiens
agcatctgattgactcact

SEQ ID NO: 4746 - DNA, 19 bp, Homo sapiens
gctgattgaggtgtccagc

SEQ ID NO: 4747 - DNA, 19 bp, Homo sapiens
ctggatcacagagtccctc

SEQ ID NO: 4748 - DNA, 19 bp, Homo sapiens
ggccctgatccccgagccc

SEQ ID NO: 4749 - DNA, 19 bp, Homo sapiens
ctcccggagccaaggctgg

SEQ ID NO: 4750 - DNA, 19 bp, Homo sapiens
gctgttttgaagactctcc

SEQ ID NO: 4751 - DNA, 19 bp, Homo sapiens
tttcaagttcctgaccttc

SEQ ID NO: 4752 - DNA, 19 bp, Homo sapiens
aatcttattggggattttg

SEQ ID NO: 4753 - DNA, 19 bp, Homo sapiens
cttccacatttcaaggaat

SEQ ID NO: 4754 - DNA, 19 bp, Homo sapiens
ccagcaagtacctgagaac

SEQ ID NO: 4755 - DNA, 19 bp, Homo sapiens
acttgaagaaaagatagtc

SEQ ID NO: 4756 - DNA, 19 bp, Homo sapiens
cagtgaagctgcagggcac

SEQ ID NO: 4757 - DNA, 19 bp, Homo sapiens
ctcacctccacctctgatc

SEQ ID NO: 4758 - DNA, 19 bp, Homo sapiens
tccactcacatcctccagt

SEQ ID NO: 4759 - DNA, 19 bp, Homo sapiens
gatgtggtcacctacctgg

SEQ ID NO: 4760 - DNA, 19 bp, Homo sapiens
tggtgctggagaatgagct

SEQ ID NO: 4761 - DNA, 19 bp, Homo sapiens
gctggagtaaaactggaag

SEQ ID NO: 4762 - DNA, 19 bp, Homo sapiens
ttcaagatgactgcactgg

SEQ ID NO: 4763 - DNA, 19 bp, Homo sapiens
cctcacagagctatcactg

SEQ ID NO: 4764 - DNA, 19 bp, Homo sapiens
gcccactggtcgcctgcca

SEQ ID NO: 4765 - DNA, 19 bp, Homo sapiens
tttgagccaacattggaag

SEQ ID NO: 4766 - DNA, 19 bp, Homo sapiens
ctttgacaggcattttgaa

SEQ ID NO: 4767 - DNA, 19 bp, Homo sapiens
cttgaaattcaatcacaag

SEQ ID NO: 4768 - DNA, 19 bp, Homo sapiens
ttctgctgccttatcagca

SEQ ID NO: 4769 - DNA, 19 bp, Homo sapiens
ctggtcagtttgcaagcaa

SEQ ID NO: 4770 - DNA, 19 bp, Homo sapiens
cctggtcagtttgcaagca

SEQ ID NO: 4771 - DNA, 19 bp, Homo sapiens
ctcacatcctccagtggct

SEQ ID NO: 4772 - DNA, 19 bp, Homo sapiens
ggaactaccacaaaaagct

SEQ ID NO: 4773 - DNA, 19 bp, Homo sapiens
gaaatcttcaatttattct

SEQ ID NO: 4774 - DNA, 19 bp, Homo sapiens
aggacaccaaaataacctt

SEQ ID NO: 4775 - DNA, 19 bp, Homo sapiens
taagaactttgccacttct

SEQ ID NO: 4776 - DNA, 19 bp, Homo sapiens
ccctaacagatttgaggat

SEQ ID NO: 4777 - DNA, 19 bp, Homo sapiens
cccctaacagatttgagga

SEQ ID NO: 4778 - DNA, 19 bp, Homo sapiens
tgcctgcctttgaagtcag

SEQ ID NO: 4779 - DNA, 19 bp, Homo sapiens
tgataaaaaccaagatgtt

SEQ ID NO: 4780 - DNA, 19 bp, Homo sapiens
atgataaaaaccaagatgt

SEQ ID NO: 4781 - DNA, 19 bp, Homo sapiens
accaccagtttgtagatga

SEQ ID NO: 4782 - DNA, 19 bp, Homo sapiens
tcttccacatttcaaggaa

SEQ ID NO: 4783 - DNA, 19 bp, Homo sapiens
acaccttccacattccttc

SEQ ID NO: 4784 - DNA, 19 bp, Homo sapiens
acactaaatacttccacaa

SEQ ID NO: 4785 - DNA, 19 bp, Homo sapiens
gtggaggcaacacattaca

SEQ ID NO: 4786 - DNA, 19 bp, Homo sapiens
aaagaaacagcatttgttt

SEQ ID NO: 4787 - DNA, 19 bp, Homo sapiens
tcttacttttccattgagt

SEQ ID NO: 4788 - DNA, 19 bp, Homo sapiens
cctccagctcctgggaaag

SEQ ID NO: 4789 - DNA, 19 bp, Homo sapiens
ttcctaaagctggatgtaa

SEQ ID NO: 4790 - DNA, 19 bp, Homo sapiens
ccacaagtcatcatctcgt

SEQ ID NO: 4791 - DNA, 19 bp, Homo sapiens
gccagaagtgagatcctcg

SEQ ID NO: 4792 - DNA, 19 bp, Homo sapiens
tgccagtctccatgacctc

SEQ ID NO: 4793 - DNA, 19 bp, Homo sapiens
gttgctcttaaggacttcc

SEQ ID NO: 4794 - DNA, 19 bp, Homo sapiens
tgttgatgaggagtccttc

SEQ ID NO: 4795 - DNA, 19 bp, Homo sapiens
gcaagtctttcctggcctg

SEQ ID NO: 4796 - DNA, 19 bp, Homo sapiens
agcaagtctttcctggcct

SEQ ID NO: 4797 - DNA, 19 bp, Homo sapiens
atgaaagtcaagcatctga

SEQ ID NO: 4798 - DNA, 19 bp, Homo sapiens
gctgactttaaaatctgac

SEQ ID NO: 4799 - DNA, 19 bp, Homo sapiens
atgcactgtttctgagtcc

SEQ ID NO: 4800 - DNA, 19 bp, Homo sapiens
ggaatatcttagcatcctt

SEQ ID NO: 4801 - DNA, 19 bp, Homo sapiens
aggaatatcttagcatcct

SEQ ID NO: 4802 - DNA, 19 bp, Homo sapiens
aaggctgactctgtggttg

SEQ ID NO: 4803 - DNA, 19 bp, Homo sapiens
aaagcaggccgaagctgtt

SEQ ID NO: 4804 - DNA, 19 bp, Homo sapiens
atccatgatctacatttgt

SEQ ID NO: 4805 - DNA, 19 bp, Homo sapiens
catcactttacaagccttg

SEQ ID NO: 4806 - DNA, 19 bp, Homo sapiens
gtctcttcgttctatgcta

SEQ ID NO: 4807 - DNA, 19 bp, Homo sapiens
agtctcttcgttctatgct

SEQ ID NO: 4808 - DNA, 19 bp, Homo sapiens
aagtgtagtctcctggtgc

SEQ ID NO: 4809 - DNA, 19 bp, Homo sapiens
tttgaggattccatcagtt

SEQ ID NO: 4810 - DNA, 19 bp, Homo sapiens
gtacctacttttggcaagc

SEQ ID NO: 4811 - DNA, 19 bp, Homo sapiens
cttatgggatttcctaaag

SEQ ID NO: 4812 - DNA, 19 bp, Homo sapiens
gagggtagtcataacagta

SEQ ID NO: 4813 - DNA, 19 bp, Homo sapiens
tggaagtgtcagtggcaaa

SEQ ID NO: 4814 - DNA, 19 bp, Homo sapiens
gatggatatgaccttctct

SEQ ID NO: 4815 - DNA, 19 bp, Homo sapiens
gagaacatactgggcagct

SEQ ID NO: 4816 - DNA, 19 bp, Homo sapiens
gagaaaatcaatgccttca

SEQ ID NO: 4817 - DNA, 19 bp, Homo sapiens
agagccaggtcgagctttc

SEQ ID NO: 4818 - DNA, 19 bp, Homo sapiens
tctgatgaggaaactcaga

SEQ ID NO: 4819 - DNA, 19 bp, Homo sapiens
aacctcccattttttgaga

SEQ ID NO: 4820 - DNA, 19 bp, Homo sapiens
ctgatccccgagccctcag

SEQ ID NO: 4821 - DNA, 19 bp, Homo sapiens
gagaaaatcaatgccttca

SEQ ID NO: 4822 - DNA, 19 bp, Homo sapiens
aagaggcagcttctggctt

SEQ ID NO: 4823 - DNA, 19 bp, Homo sapiens
atcaaaagaagcccaagag

SEQ ID NO: 4824 - DNA, 19 bp, Homo sapiens
tcaaagttaattgggaaga

SEQ ID NO: 4825 - DNA, 19 bp, Homo sapiens
ctcaattttgattttcaag

SEQ ID NO: 4826 - DNA, 19 bp, Homo sapiens
gatggaaccctctccctca

SEQ ID NO: 4827 - DNA, 19 bp, Homo sapiens
ctgacatcttaggcactga

SEQ ID NO: 4828 - DNA, 19 bp, Homo sapiens
ttcagaagctaagcaatgt

SEQ ID NO: 4829 - DNA, 19 bp, Homo sapiens
tctctgaaagacaacgtgc

SEQ ID NO: 4830 - DNA, 19 bp, Homo sapiens
agataacattaaacagctg

SEQ ID NO: 4831 - DNA, 19 bp, Homo sapiens
ggctcaacacagacatcgc

SEQ ID NO: 4832 - DNA, 19 bp, Homo sapiens
tcccagaaaacctcttctt

SEQ ID NO: 4833 - DNA, 19 bp, Homo sapiens
caatggagagtccaacctg

SEQ ID NO: 4834 - DNA, 19 bp, Homo sapiens
gcaagggttcactgttcct

SEQ ID NO: 4835 - DNA, 19 bp, Homo sapiens
aattgggaagaagaggcag

SEQ ID NO: 4836 - DNA, 19 bp, Homo sapiens
gaatattttgagaggaatc

SEQ ID NO: 4837 - DNA, 19 bp, Homo sapiens
atgaagtagaccaacaaat

SEQ ID NO: 4838 - DNA, 19 bp, Homo sapiens
atttgtaagaaaatacaga

SEQ ID NO: 4839 - DNA, 19 bp, Homo sapiens
agtttctccatcctaggtt

SEQ ID NO: 4840 - DNA, 19 bp, Homo sapiens
ttctgaaaatccaatctcc

SEQ ID NO: 4841 - DNA, 19 bp, Homo sapiens
aagatcgcagactttgagt

SEQ ID NO: 4842 - DNA, 19 bp, Homo sapiens
tgaactcagaagaattgga

SEQ ID NO: 4843 - DNA, 19 bp, Homo sapiens
cagtcatgtagaaaaactt

SEQ ID NO: 4844 - DNA, 19 bp, Homo sapiens
ctggaactctctccatggc

SEQ ID NO: 4845 - DNA, 19 bp, Homo sapiens
tctgaactcagaaggatgg

SEQ ID NO: 4846 - DNA, 19 bp, Homo sapiens
ggatttcctaaagctggat

SEQ ID NO: 4847 - DNA, 19 bp, Homo sapiens
cctgaaatacaatgctctg

SEQ ID NO: 4848 - DNA, 19 bp, Homo sapiens
agaaacagcatttgtttgt

SEQ ID NO: 4849 - DNA, 19 bp, Homo sapiens
agaagctaagcaatgtcct

SEQ ID NO: 4850 - DNA, 19 bp, Homo sapiens
tgaaggctgactctgtggt

SEQ ID NO: 4851 - DNA, 19 bp, Homo sapiens
atcaggaagggctcaaaga

SEQ ID NO: 4852 - DNA, 19 bp, Homo sapiens
tcattactcctgggctgaa

SEQ ID NO: 4853 - DNA, 19 bp, Homo sapiens
tgaatctggctccctcaac

SEQ ID NO: 4854 - DNA, 19 bp, Homo sapiens
ttaatcgagaggtatgaag

SEQ ID NO: 4855 - DNA, 19 bp, Homo sapiens
gttaatcgagaggtatgaa

SEQ ID NO: 4856 - DNA, 19 bp, Homo sapiens
aattgcattagatgatgcc

SEQ ID NO: 4857 - DNA, 19 bp, Homo sapiens
tggagtttgtgacaaatat

SEQ ID NO: 4858 - DNA, 19 bp, Homo sapiens
agaaacagcatttgtttgt

SEQ ID NO: 4859 - DNA, 19 bp, Homo sapiens
caaatgacatgatgggctc

SEQ ID NO: 4860 - DNA, 19 bp, Homo sapiens
aagcatctgattgactcac

SEQ ID NO: 4861 - DNA, 19 bp, Homo sapiens
tgggcctgccccagattct

SEQ ID NO: 4862 - DNA, 19 bp, Homo sapiens
caataagatcaatagcaaa

SEQ ID NO: 4863 - DNA, 19 bp, Homo sapiens
ttggctcacatgaaggcca

SEQ ID NO: 4864 - DNA, 19 bp, Homo sapiens
gatatacactagggaggaa

SEQ ID NO: 4865 - DNA, 19 bp, Homo sapiens
agatcaaagttaattggga

SEQ ID NO: 4866 - DNA, 19 bp, Homo sapiens
gagtcccagtgcccagcaa

SEQ ID NO: 4867 - DNA, 19 bp, Homo sapiens
tcagtataagtacaaccaa

SEQ ID NO: 4868 - DNA, 19 bp, Homo sapiens
aacttccaactgtcatgga

SEQ ID NO: 4869 - DNA, 19 bp, Homo sapiens
ctttgaagtcagtcttcag

SEQ ID NO: 4870 - DNA, 19 bp, Homo sapiens
agaatctcaacttccaact

SEQ ID NO: 4871 - DNA, 19 bp, Homo sapiens
acaggggtcctttatgatt

SEQ ID NO: 4872 - DNA, 19 bp, Homo sapiens
atttgaaagaataaatgac

SEQ ID NO: 4873 - DNA, 19 bp, Homo sapiens
aacacattgaggctattga

SEQ ID NO: 4874 - DNA, 19 bp, Homo sapiens
gaaaaaggggattgaagtt

SEQ ID NO: 4875 - DNA, 19 bp, Homo sapiens
ataagcaaactgttaattt

SEQ ID NO: 4876 - DNA, 19 bp, Homo sapiens
aaatgcactgctgcgttct

SEQ ID NO: 4877 - DNA, 19 bp, Homo sapiens
caaaaacattttcaacttc

SEQ ID NO: 4878 - DNA, 19 bp, Homo sapiens
aaggaagaaagaaaaatca

SEQ ID NO: 4879 - DNA, 19 bp, Homo sapiens
gtcagcccagttccttcca

SEQ ID NO: 4880 - DNA, 19 bp, Homo sapiens
tgaggaaactcagatcaaa

SEQ ID NO: 4881 - DNA, 19 bp, Homo sapiens
aaagcattggtagagcaag

SEQ ID NO: 4882 - DNA, 19 bp, Homo sapiens
tcaagtctgtgggattcca

SEQ ID NO: 4883 - DNA, 19 bp, Homo sapiens
ccaagaggtatttaaagcc

SEQ ID NO: 4884 - DNA, 19 bp, Homo sapiens
agctttctgccactgctca

SEQ ID NO: 4885 - DNA, 19 bp, Homo sapiens
gagctttctgccactgctc

SEQ ID NO: 4886 - DNA, 19 bp, Homo sapiens
aaaagaaacagcatttgtt

SEQ ID NO: 4887 - DNA, 19 bp, Homo sapiens
ttccggcacgtgggttcca

SEQ ID NO: 4888 - DNA, 19 bp, Homo sapiens
ccttactgactttgcagag

SEQ ID NO: 4889 - DNA, 19 bp, Homo sapiens
aatcattgaaaaattaaaa

SEQ ID NO: 4890 - DNA, 19 bp, Homo sapiens
ttgatgaaatcattgaaaa

SEQ ID NO: 4891 - DNA, 19 bp, Homo sapiens
tcattgctcccggagccaa

SEQ ID NO: 4892 - DNA, 19 bp, Homo sapiens
tgttgcttttgtaaagtat

SEQ ID NO: 4893 - DNA, 19 bp, Homo sapiens
catttcagccttcgggctc

SEQ ID NO: 4894 - DNA, 19 bp, Homo sapiens
gcatgcctagtttctccat

SEQ ID NO: 4895 - DNA, 19 bp, Homo sapiens
agcacagtacgaaaaacca

SEQ ID NO: 4896 - DNA, 19 bp, Homo sapiens
ctgaaagagatgaaattta

SEQ ID NO: 4897 - DNA, 19 bp, Homo sapiens
aacagatttgaggattcca

SEQ ID NO: 4898 - DNA, 19 bp, Homo sapiens
atcacaactcctccactga

SEQ ID NO: 4899 - DNA, 19 bp, Homo sapiens
aatcacaactcctccactg

SEQ ID NO: 4900 - DNA, 19 bp, Homo sapiens
taatcacaactcctccact

SEQ ID NO: 4901 - DNA, 19 bp, Homo sapiens
ggatactaagtaccaaatc

SEQ ID NO: 4902 - DNA, 19 bp, Homo sapiens
cttccgtttaccagaaatc

SEQ ID NO: 4903 - DNA, 19 bp, Homo sapiens
acttccgtttaccagaaat

SEQ ID NO: 4904 - DNA, 19 bp, Homo sapiens
ttccaatttccctgtggat

SEQ ID NO: 4905 - DNA, 19 bp, Homo sapiens
cttccaatttccctgtgga

SEQ ID NO: 4906 - DNA, 19 bp, Homo sapiens
agattaatccgctggctct

SEQ ID NO: 4907 - DNA, 19 bp, Homo sapiens
aagattaatccgctggctc

SEQ ID NO: 4908 - DNA, 19 bp, Homo sapiens
accactgggacctaccaag

SEQ ID NO: 4909 - DNA, 19 bp, Homo sapiens
actggtggcaaaaccctcc

SEQ ID NO: 4910 - DNA, 19 bp, Homo sapiens
tggagaagccacactccaa

SEQ ID NO: 4911 - DNA, 19 bp, Homo sapiens
ctggtcgcctgccaaactg

SEQ ID NO: 4912 - DNA, 19 bp, Homo sapiens
ggagtcattgctcccggag

SEQ ID NO: 4913 - DNA, 19 bp, Homo sapiens
tcagaaagctaccttccag

SEQ ID NO: 4914 - DNA, 19 bp, Homo sapiens
agccagaagtgagatcctc

SEQ ID NO: 4915 - DNA, 19 bp, Homo sapiens
gaaggcatctgggagtctt

SEQ ID NO: 4916 - DNA, 19 bp, Homo sapiens
gatgcttacaacactaaag

SEQ ID NO: 4917 - DNA, 19 bp, Homo sapiens
ggcacttccaaaattgatg

SEQ ID NO: 4918 - DNA, 19 bp, Homo sapiens
aaagttaattgggaagaag

SEQ ID NO: 4919 - DNA, 19 bp, Homo sapiens
tgggctggcttcagccatt

SEQ ID NO: 4920 - DNA, 19 bp, Homo sapiens
cagtctgaacattgcaggc

SEQ ID NO: 4921 - DNA, 19 bp, Homo sapiens
cagtgcaacgaccaacttg

SEQ ID NO: 4922 - DNA, 19 bp, Homo sapiens
tactccaacgccagctcca

SEQ ID NO: 4923 - DNA, 19 bp, Homo sapiens
ctgccatctcgagagttcc

SEQ ID NO: 4924 - DNA, 19 bp, Homo sapiens
tgcctttgtgtacaccaaa

SEQ ID NO: 4925 - DNA, 19 bp, Homo sapiens
gatgggtctctacgccaca

SEQ ID NO: 4926 - DNA, 19 bp, Homo sapiens
cccaaggccacaggggtcc

SEQ ID NO: 4927 - DNA, 19 bp, Homo sapiens
gtgttctagacctctccac

SEQ ID NO: 4928 - DNA, 19 bp, Homo sapiens
ccagaatctgtaccaggaa

SEQ ID NO: 4929 - DNA, 19 bp, Homo sapiens
tgagaactacgagctgact

SEQ ID NO: 4930 - DNA, 19 bp, Homo sapiens
catgaaggccaaattccga

SEQ ID NO: 4931 - DNA, 19 bp, Homo sapiens
cttccagacacctgatttt

SEQ ID NO: 4932 - DNA, 19 bp, Homo sapiens
gaatttacaattgttgctt

SEQ ID NO: 4933 - DNA, 19 bp, Homo sapiens
gagcttcaggaagcttctc

SEQ ID NO: 4934 - DNA, 19 bp, Homo sapiens
accagtcagatattgttgc

SEQ ID NO: 4935 - DNA, 19 bp, Homo sapiens
tagaatatgaactaaatgt

SEQ ID NO: 4936 - DNA, 19 bp, Homo sapiens
gtagctgagaaaatcaatg

SEQ ID NO: 4937 - DNA, 19 bp, Homo sapiens
ggtggataccctgaagttt

SEQ ID NO: 4938 - DNA, 19 bp, Homo sapiens
aggaaaagcgcacctcaat

SEQ ID NO: 4939 - DNA, 19 bp, Homo sapiens
ccagcttccccacatctca

SEQ ID NO: 4940 - DNA, 19 bp, Homo sapiens
gtaagaaaatacagagcag

SEQ ID NO: 4941 - DNA, 19 bp, Homo sapiens
aggacagagccttggtgga

SEQ ID NO: 4942 - DNA, 19 bp, Homo sapiens
atctgatgaggaaactcag

SEQ ID NO: 4943 - DNA, 19 bp, Homo sapiens
ggcctctctggggcatcta

SEQ ID NO: 4944 - DNA, 19 bp, Homo sapiens
ctctcacaaaaaagtatag

SEQ ID NO: 4945 - DNA, 19 bp, Homo sapiens
cttcaggaagcttctcaag

SEQ ID NO: 4946 - DNA, 19 bp, Homo sapiens
ccttacacaataatcacaa

SEQ ID NO: 4947 - DNA, 19 bp, Homo sapiens
gcacctagctggaaagtta

SEQ ID NO: 4948 - DNA, 19 bp, Homo sapiens
tctgtgggattccatctgc

SEQ ID NO: 4949 - DNA, 19 bp, Homo sapiens
gtctgtgggattccatctg

SEQ ID NO: 4950 - DNA, 19 bp, Homo sapiens
tcaccaacggagaacatac

SEQ ID NO: 4951 - DNA, 19 bp, Homo sapiens
ttcaccaacggagaacata

SEQ ID NO: 4952 - DNA, 19 bp, Homo sapiens
aatctcaagctttctcttc

SEQ ID NO: 4953 - DNA, 19 bp, Homo sapiens
tgtacaactggtccgcctc

SEQ ID NO: 4954 - DNA, 19 bp, Homo sapiens
ctgttaggacaccagccct

SEQ ID NO: 4955 - DNA, 19 bp, Homo sapiens
tgaaattcaatcacaagtc

SEQ ID NO: 4956 - DNA, 19 bp, Homo sapiens
tcttttcttttcagcccag

SEQ ID NO: 4957 - DNA, 19 bp, Homo sapiens
caactgcagacatatatga

SEQ ID NO: 4958 - DNA, 19 bp, Homo sapiens
tcactccattaacctccca

SEQ ID NO: 4959 - DNA, 19 bp, Homo sapiens
cttcttttccaattgaact

SEQ ID NO: 4960 - DNA, 19 bp, Homo sapiens
tcttcatcttcatctgtca

SEQ ID NO: 4961 - DNA, 19 bp, Homo sapiens
ttcttcatcttcatctgtc

SEQ ID NO: 4962 - DNA, 19 bp, Homo sapiens
cttgtcatgcctacgttcc

SEQ ID NO: 4963 - DNA, 19 bp, Homo sapiens
aaatcttattggggatttt

SEQ ID NO: 4964 - DNA, 19 bp, Homo sapiens
cttggattcaaaatgtgga

SEQ ID NO: 4965 - DNA, 19 bp, Homo sapiens
cttcagggaacacaatgca

SEQ ID NO: 4966 - DNA, 19 bp, Homo sapiens
atctatgccatctcttctg

SEQ ID NO: 4967 - DNA, 19 bp, Homo sapiens
ccagcttccccacatctca

SEQ ID NO: 4968 - DNA, 19 bp, Homo sapiens
agcacatatgaactggacc

SEQ ID NO: 4969 - DNA, 19 bp, Homo sapiens
gagtttatcagtcagagca

SEQ ID NO: 4970 - DNA, 19 bp, Homo sapiens
gctgcagtggcccgttcca

SEQ ID NO: 4971 - DNA, 19 bp, Homo sapiens
tggaggacattcctctagc

SEQ ID NO: 4972 - DNA, 19 bp, Homo sapiens
atcacaaattagtttcacc

SEQ ID NO: 4973 - DNA, 19 bp, Homo sapiens
ttcaacgatacctgtctct

SEQ ID NO: 4974 - DNA, 19 bp, Homo sapiens
gtatgctaatagactcctg

SEQ ID NO: 4975 - DNA, 19 bp, Homo sapiens
cacaatgcaaaattcagtc

SEQ ID NO: 4976 - DNA, 19 bp, Homo sapiens
tcataagggaggtagggac

SEQ ID NO: 4977 - DNA, 19 bp, Homo sapiens
ggaactacaatttcatttg

SEQ ID NO: 4978 - DNA, 19 bp, Homo sapiens
atgatttgaaaatagctat

SEQ ID NO: 4979 - DNA, 19 bp, Homo sapiens
cccaagaggtatttaaagc

SEQ ID NO: 4980 - DNA, 19 bp, Homo sapiens
gttcactccattaacctcc

SEQ ID NO: 4981 - DNA, 19 bp, Homo sapiens
ttttctaaatggaacttct

SEQ ID NO: 4982 - DNA, 19 bp, Homo sapiens
ctttgaaaaattctctttt

SEQ ID NO: 4983 - DNA, 19 bp, Homo sapiens
gaccttgcaagaatatttt

SEQ ID NO: 4984 - DNA, 19 bp, Homo sapiens
tgttaacaaattccttgac

SEQ ID NO: 4985 - DNA, 19 bp, Homo sapiens
ttcaagttcctgaccttca

SEQ ID NO: 4986 - DNA, 19 bp, Homo sapiens
gaatctggctccctcaact

SEQ ID NO: 4987 - DNA, 19 bp, Homo sapiens
ggaaataccaagtcaaaac

SEQ ID NO: 4988 - DNA, 19 bp, Homo sapiens
aaggaaaagcgcacctcaa

SEQ ID NO: 4989 - DNA, 19 bp, Homo sapiens
cagttgaccacaagcttag

SEQ ID NO: 4990 - DNA, 19 bp, Homo sapiens
tccttaacaccttccacat

SEQ ID NO: 4991 - DNA, 19 bp, Homo sapiens
gacttctctagtcaggctg

SEQ ID NO: 4992 - DNA, 19 bp, Homo sapiens
agacatcgctgggctggct

SEQ ID NO: 4993 - DNA, 19 bp, Homo sapiens
ctctcaaatgacatgatgg

SEQ ID NO: 4994 - DNA, 19 bp, Homo sapiens
gttgagaagccccaagaat

SEQ ID NO: 4995 - DNA, 19 bp, Homo sapiens
gagatcaagacactgttga

SEQ ID NO: 4996 - DNA, 19 bp, Homo sapiens
tggaaccctctccctcacc

SEQ ID NO: 4997 - DNA, 19 bp, Homo sapiens
gctggtaacctaaaaggag

SEQ ID NO: 4998 - DNA, 19 bp, Homo sapiens
gttgcccaccatcatcgtg

SEQ ID NO: 4999 - DNA, 19 bp, Homo sapiens
agttgcccaccatcatcgt

SEQ ID NO: 5000 - DNA, 19 bp, Homo sapiens
tgttagttgctcttaagga

SEQ ID NO: 5001 - DNA, 19 bp, Homo sapiens
cagcaagtacctgagaacg

SEQ ID NO: 5002 - DNA, 19 bp, Homo sapiens
aacctatgccttaatcttc

SEQ ID NO: 5003 - DNA, 19 bp, Homo sapiens
ggaaagttaaaacaacaca

SEQ ID NO: 5004 - DNA, 19 bp, Homo sapiens
cacaccttgacattgcagg

SEQ ID NO: 5005 - DNA, 19 bp, Homo sapiens
gcacaccttgacattgcag

SEQ ID NO: 5006 - DNA, 19 bp, Homo sapiens
atccgctggctctgaagga

SEQ ID NO: 5007 - DNA, 19 bp, Homo sapiens
acgtccgtgtgccttcata

SEQ ID NO: 5008 - DNA, 19 bp, Homo sapiens
gacgtccgtgtgccttcat

SEQ ID NO: 5009 - DNA, 19 bp, Homo sapiens
tgattatctgaattcattc

SEQ ID NO: 5010 - DNA, 19 bp, Homo sapiens
tgatttacatgatttgaaa

SEQ ID NO: 5011 - DNA, 19 bp, Homo sapiens
tgaagtagctgagaaaatc

SEQ ID NO: 5012 - DNA, 19 bp, Homo sapiens
tttgaaaaattctcttttc

SEQ ID NO: 5013 - DNA, 19 bp, Homo sapiens
taaattcattactcctggg

SEQ ID NO: 5014 - DNA, 19 bp, Homo sapiens
tattcaaaactgagttgag

SEQ ID NO: 5015 - DNA, 19 bp, Homo sapiens
atattcaaaactgagttga

SEQ ID NO: 5016 - DNA, 19 bp, Homo sapiens
gaatttgaaagttcgtttt

SEQ ID NO: 5017 - DNA, 19 bp, Homo sapiens
gacagcatcttcgtgtttc

SEQ ID NO: 5018 - DNA, 19 bp, Homo sapiens
acttaaaaaatataaaaat

SEQ ID NO: 5019 - DNA, 19 bp, Homo sapiens
aactctcaagtcaagttga

SEQ ID NO: 5020 - DNA, 19 bp, Homo sapiens
agaagatggcaaatttgaa

SEQ ID NO: 5021 - DNA, 19 bp, Homo sapiens
atagcatggacttcttctg

SEQ ID NO: 5022 - DNA, 19 bp, Homo sapiens
ccatttgagatcacggcat

SEQ ID NO: 5023 - DNA, 19 bp, Homo sapiens
caagttggcaagtaagtgc

SEQ ID NO: 5024 - DNA, 19 bp, Homo sapiens
taaagtgccacttttactc

SEQ ID NO: 5025 - DNA, 19 bp, Homo sapiens
ttaacagggaagatagact

SEQ ID NO: 5026 - DNA, 19 bp, Homo sapiens
ttggcaagtaagtgctagg

SEQ ID NO: 5027 - DNA, 19 bp, Homo sapiens
gggaagaagaggcagcttc

SEQ ID NO: 5028 - DNA, 19 bp, Homo sapiens
gatgaggaaactcagatca

SEQ ID NO: 5029 - DNA, 19 bp, Homo sapiens
tgatgaggaaactcagatc

SEQ ID NO: 5030 - DNA, 19 bp, Homo sapiens
tctcgtgtctaggaaaagc

SEQ ID NO: 5031 - DNA, 19 bp, Homo sapiens
cagcttaagagacacatac

SEQ ID NO: 5032 - DNA, 19 bp, Homo sapiens
tcattttccaactaataga

SEQ ID NO: 5033 - DNA, 19 bp, Homo sapiens
gatacaagaaaaactgcag

SEQ ID NO: 5034 - DNA, 19 bp, Homo sapiens
ggctcatatgctgaaatga

SEQ ID NO: 5035 - DNA, 19 bp, Homo sapiens
ggaaggacaaggcccagaa

SEQ ID NO: 5036 - DNA, 19 bp, Homo sapiens
atttttattcctgccatgg

SEQ ID NO: 5037 - DNA, 19 bp, Homo sapiens
attttttgcaagttaaaga

SEQ ID NO: 5038 - DNA, 19 bp, Homo sapiens
atccatgatctacatttgt

SEQ ID NO: 5039 - DNA, 19 bp, Homo sapiens
cttcagggaacacaatgca

SEQ ID NO: 5040 - DNA, 19 bp, Homo sapiens
gagatgagagatgccgttg

SEQ ID NO: 5041 - DNA, 19 bp, Homo sapiens
attctcttttcttttcagc

SEQ ID NO: 5042 - DNA, 19 bp, Homo sapiens
cagatacaagaaaaactgc

SEQ ID NO: 5043 - DNA, 19 bp, Homo sapiens
ttcattcaattgggagaga

SEQ ID NO: 5044 - DNA, 19 bp, Homo sapiens
atttgtaagaaaatacaga

SEQ ID NO: 5045 - DNA, 19 bp, Homo sapiens
ctgaagcattaaaactgtt

SEQ ID NO: 5046 - DNA, 19 bp, Homo sapiens
ccagatgctgaacagtgag

SEQ ID NO: 5047 - DNA, 19 bp, Homo sapiens
gcctacgttccatgtccca

SEQ ID NO: 5048 - DNA, 19 bp, Homo sapiens
cttcagtgcagaatatgaa

SEQ ID NO: 5049 - DNA, 19 bp, Homo sapiens
atgattatctgaattcatt

SEQ ID NO: 5050 - DNA, 19 bp, Homo sapiens
ttcagccattgacatgagc

SEQ ID NO: 5051 - DNA, 19 bp, Homo sapiens
aaatagctattgctaatat

SEQ ID NO: 5052 - DNA, 19 bp, Homo sapiens
taagaaccagaagatcaga

SEQ ID NO: 5053 - DNA, 19 bp, Homo sapiens
tgatatcgacgtgaggttc

SEQ ID NO: 5054 - DNA, 19 bp, Homo sapiens
gtcctggattccacatgca

SEQ ID NO: 5055 - DNA, 19 bp, Homo sapiens
aaattccttgacatgttga

SEQ ID NO: 5056 - DNA, 19 bp, Homo sapiens
acttaaaaaatataaaaat

SEQ ID NO: 5057 - DNA, 19 bp, Homo sapiens
cttacttgaattccaagag

SEQ ID NO: 5058 - DNA, 19 bp, Homo sapiens
gctgcatgtggctggtaac

SEQ ID NO: 5059 - DNA, 19 bp, Homo sapiens
taaaagattactttgagaa

SEQ ID NO: 5060 - DNA, 19 bp, Homo sapiens
ttggcaagtaagtgctagg

SEQ ID NO: 5061 - DNA, 19 bp, Homo sapiens
atttacaattgttgctttt

SEQ ID NO: 5062 - DNA, 19 bp, Homo sapiens
attacctatgatttctcct

SEQ ID NO: 5063 - DNA, 19 bp, Homo sapiens
atgtcaaacactttgttat

SEQ ID NO: 5064 - DNA, 19 bp, Homo sapiens
gatgaagatgacgactttt

SEQ ID NO: 5065 - DNA, 19 bp, Homo sapiens
cacaagtcgattcccagca

SEQ ID NO: 5066 - DNA, 19 bp, Homo sapiens
tgaggtgactcagagactc

SEQ ID NO: 5067 - DNA, 19 bp, Homo sapiens
gtcagtgaagttctccagc

SEQ ID NO: 5068 - DNA, 19 bp, Homo sapiens
cggagcatgggagtgaaat

SEQ ID NO: 5069 - DNA, 19 bp, Homo sapiens
acggagcatgggagtgaaa

SEQ ID NO: 5070 - DNA, 19 bp, Homo sapiens
aacggagcatgggagtgaa

SEQ ID NO: 5071 - DNA, 19 bp, Homo sapiens
agaagtgtcttcaaagctg

SEQ ID NO: 5072 - DNA, 19 bp, Homo sapiens
cattcaattgggagagaca

SEQ ID NO: 5073 - DNA, 19 bp, Homo sapiens
ccattcagtctctcaagac

SEQ ID NO: 5074 - DNA, 19 bp, Homo sapiens
cagataaaaaactcaccat

SEQ ID NO: 5075 - DNA, 19 bp, Homo sapiens
gctgttttgaagactctcc

SEQ ID NO: 5076 - DNA, 19 bp, Homo sapiens
cagaattcataatcccaac

SEQ ID NO: 5077 - DNA, 19 bp, Homo sapiens
actgcaagatttttcagac

SEQ ID NO: 5078 - DNA, 19 bp, Homo sapiens
caagaacctgttagttgct

SEQ ID NO: 5079 - DNA, 19 bp, Homo sapiens
gcacatcaatattgatcaa

SEQ ID NO: 5080 - DNA, 19 bp, Homo sapiens
tttcagatggcattgctgc

SEQ ID NO: 5081 - DNA, 19 bp, Homo sapiens
aaatcccatccaggttttc

SEQ ID NO: 5082 - DNA, 19 bp, Homo sapiens
tcctttggctgtgctttgt

SEQ ID NO: 5083 - DNA, 19 bp, Homo sapiens
agtgaagttctccagcaag

SEQ ID NO: 5084 - DNA, 19 bp, Homo sapiens
ccagaattcataatcccaa

SEQ ID NO: 5085 - DNA, 19 bp, Homo sapiens
ggctattgatgttagagtg

SEQ ID NO: 5086 - DNA, 19 bp, Homo sapiens
ggcatgatgctcatttaaa

SEQ ID NO: 5087 - DNA, 19 bp, Homo sapiens
taaagccattcagtctctc

SEQ ID NO: 5088 - DNA, 19 bp, Homo sapiens
tttaaccagtcagatattg

SEQ ID NO: 5089 - DNA, 19 bp, Homo sapiens
tttattgctgaatccaaaa

SEQ ID NO: 5090 - DNA, 19 bp, Homo sapiens
ttttgagaggaatcgacaa

SEQ ID NO: 5091 - DNA, 19 bp, Homo sapiens
gggaaaaaacaggcttgaa

SEQ ID NO: 5092 - DNA, 19 bp, Homo sapiens
ttctctctatgggaaaaaa

SEQ ID NO: 5093 - DNA, 19 bp, Homo sapiens
caaaagaagcccaagaggt

SEQ ID NO: 5094 - DNA, 19 bp, Homo sapiens
acaaagcagattatgttga

SEQ ID NO: 5095 - DNA, 19 bp, Homo sapiens
ttttcagaccaactctctg

SEQ ID NO: 5096 - DNA, 19 bp, Homo sapiens
ctgtctctggtcagccagg

SEQ ID NO: 5097 - DNA, 19 bp, Homo sapiens
attacacttcctttcgagt

SEQ ID NO: 5098 - DNA, 19 bp, Homo sapiens
tctcttcctccatggaatt

SEQ ID NO: 5099 - DNA, 19 bp, Homo sapiens
cttggagtgccagtttgaa

SEQ ID NO: 5100 - DNA, 19 bp, Homo sapiens
agagcttatgggatttcct

SEQ ID NO: 5101 - DNA, 19 bp, Homo sapiens
ttttggcaagctatacagt

SEQ ID NO: 5102 - DNA, 19 bp, Homo sapiens
ctttgtgagtttatcagtc

SEQ ID NO: 5103 - DNA, 19 bp, Homo sapiens
attggatatccaagatctg

SEQ ID NO: 5104 - DNA, 19 bp, Homo sapiens
ttaaaagaaatcttcaatt

SEQ ID NO: 5105 - DNA, 19 bp, Homo sapiens
tcaatgattatatcccata

SEQ ID NO: 5106 - DNA, 19 bp, Homo sapiens
agcacagaaaaaattcaaa

SEQ ID NO: 5107 - DNA, 19 bp, Homo sapiens
tagcacagaaaaaattcaa

SEQ ID NO: 5108 - DNA, 19 bp, Homo sapiens
aataaatggagtctttatt

SEQ ID NO: 5109 - DNA, 19 bp, Homo sapiens
caataccagaattcataat

SEQ ID NO: 5110 - DNA, 19 bp, Homo sapiens
tagtgattacacttccttt

SEQ ID NO: 5111 - DNA, 19 bp, Homo sapiens
atagcaacactaaatactt

SEQ ID NO: 5112 - DNA, 19 bp, Homo sapiens
atatccaagatgagatcaa

SEQ ID NO: 5113 - DNA, 19 bp, Homo sapiens
attgagattccctccatta

SEQ ID NO: 5114 - DNA, 19 bp, Homo sapiens
tggagtgccagtttgaaaa

SEQ ID NO: 5115 - DNA, 19 bp, Homo sapiens
atttcctaaagctggatgt

SEQ ID NO: 5116 - DNA, 19 bp, Homo sapiens
cactgttccagttgtcaat

SEQ ID NO: 5117 - DNA, 19 bp, Homo sapiens
cttcaaagacttaaaaaat

SEQ ID NO: 5118 - DNA, 19 bp, Homo sapiens
tgtaccataagccatattt

SEQ ID NO: 5119 - DNA, 19 bp, Homo sapiens
ttttctaaacttgaaattc

SEQ ID NO: 5120 - DNA, 19 bp, Homo sapiens
ttcttaaacattcctttaa

SEQ ID NO: 5121 - DNA, 19 bp, Homo sapiens
ttccaatttccctgtggat

SEQ ID NO: 5122 - DNA, 19 bp, Homo sapiens
aaagtgccacttttactca

SEQ ID NO: 5123 - DNA, 19 bp, Homo sapiens
caaatgacatgatgggctc

SEQ ID NO: 5124 - DNA, 19 bp, Homo sapiens
gattatatcccatatgttt

SEQ ID NO: 5125 - DNA, 19 bp, Homo sapiens
gaaggaaaagcgcacctca

SEQ ID NO: 5126 - DNA, 19 bp, Homo sapiens
tttgtggagggtagtcata

SEQ ID NO: 5127 - DNA, 19 bp, Homo sapiens
tggatgaagatgacgactt

SEQ ID NO: 5128 - DNA, 19 bp, Homo sapiens
gaataccaatgctgaactt

SEQ ID NO: 5129 - DNA, 19 bp, Homo sapiens
atctaaattcagttcttgt

SEQ ID NO: 5130 - DNA, 19 bp, Homo sapiens
caaaatagaagggaatctt

SEQ ID NO: 5131 - DNA, 19 bp, Homo sapiens
ctaaacttgaaattcaatc

SEQ ID NO: 5132 - DNA, 19 bp, Homo sapiens
aaatccgtgaggtgactca

SEQ ID NO: 5133 - DNA, 19 bp, Homo sapiens
caattttgagaatgaattt

SEQ ID NO: 5134 - DNA, 19 bp, Homo sapiens
agcatgcctagtttctcca

SEQ ID NO: 5135 - DNA, 19 bp, Homo sapiens
ttgtagatgaaaccaatga

SEQ ID NO: 5136 - DNA, 19 bp, Homo sapiens
tttgtagatgaaaccaatg

SEQ ID NO: 5137 - DNA, 19 bp, Homo sapiens
atttaagtatgatttcaat

SEQ ID NO: 5138 - DNA, 19 bp, Homo sapiens
aatttaagtatgatttcaa

SEQ ID NO: 5139 - DNA, 19 bp, Homo sapiens
gaatttaagtatgatttca

SEQ ID NO: 5140 - DNA, 19 bp, Homo sapiens
aattccctgaagttgatgt

SEQ ID NO: 5141 - DNA, 19 bp, Homo sapiens
caaattgaacatccccaaa

SEQ ID NO: 5142 - DNA, 19 bp, Homo sapiens
agtccccctaacagatttg

SEQ ID NO: 5143 - DNA, 19 bp, Homo sapiens
gagtgaaatgctgtttttt

SEQ ID NO: 5144 - DNA, 19 bp, Homo sapiens
ttgatgatatctggaacct

SEQ ID NO: 5145 - DNA, 19 bp, Homo sapiens
tccaatctcctcttttcac

SEQ ID NO: 5146 - DNA, 19 bp, Homo sapiens
tttcaagcaaatgcacaac

SEQ ID NO: 5147 - DNA, 19 bp, Homo sapiens
ccaatgctgaactttttaa

SEQ ID NO: 5148 - DNA, 19 bp, Homo sapiens
tctcctttcttcatcttca

SEQ ID NO: 5149 - DNA, 19 bp, Homo sapiens
aatgaagtccggattcatt

SEQ ID NO: 5150 - DNA, 19 bp, Homo sapiens
gttgagaagccccaagaat

SEQ ID NO: 5151 - DNA, 19 bp, Homo sapiens
tggcaagtaagtgctaggt

SEQ ID NO: 5152 - DNA, 19 bp, Homo sapiens
ctggacttctctagtcagg

SEQ ID NO: 5153 - DNA, 19 bp, Homo sapiens
gctaaaggagcagttgacc

SEQ ID NO: 5154 - DNA, 19 bp, Homo sapiens
aagtccggattcattctgg

SEQ ID NO: 5155 - DNA, 19 bp, Homo sapiens
tgacctgtccattcaaaac

SEQ ID NO: 5156 - DNA, 19 bp, Homo sapiens
agaaaaaggggattgaagt

SEQ ID NO: 5157 - DNA, 19 bp, Homo sapiens
gcaagttaaagaaaatcag

SEQ ID NO: 5158 - DNA, 19 bp, Homo sapiens
gctcatctcctttcttcat

SEQ ID NO: 5159 - DNA, 19 bp, Homo sapiens
tgctcatctcctttcttca

SEQ ID NO: 5160 - DNA, 19 bp, Homo sapiens
tttcaccatagaaggaccc

SEQ ID NO: 5161 - DNA, 19 bp, Homo sapiens
gtccccctaacagatttga

SEQ ID NO: 5162 - DNA, 19 bp, Homo sapiens
ggcaccagggctcggaagg

SEQ ID NO: 5163 - DNA, 19 bp, Homo sapiens
gcttgaaggaattcttgaa

SEQ ID NO: 5164 - DNA, 19 bp, Homo sapiens
tcttcataagttcaatgaa

SEQ ID NO: 5165 - DNA, 19 bp, Homo sapiens
ttttaacaaaagtggaagt

SEQ ID NO: 5166 - DNA, 19 bp, Homo sapiens
tggagaagcaaatctggat

SEQ ID NO: 5167 - DNA, 19 bp, Homo sapiens
tgttgaagtgtctccattc

SEQ ID NO: 5168 - DNA, 19 bp, Homo sapiens
aattccaattttgagaatg

SEQ ID NO: 5169 - DNA, 19 bp, Homo sapiens
ctgttgaaagatttatcaa

SEQ ID NO: 5170 - DNA, 19 bp, Homo sapiens
gaagttctcaattttgatt

SEQ ID NO: 5171 - DNA, 19 bp, Homo sapiens
ttcttctggaaaagggtca

SEQ ID NO: 5172 - DNA, 19 bp, Homo sapiens
agattctcagatgagggaa

SEQ ID NO: 5173 - DNA, 19 bp, Homo sapiens
tcagatggcattgctgctt

SEQ ID NO: 5174 - DNA, 19 bp, Homo sapiens
gagataaccgtgcctgaat

SEQ ID NO: 5175 - DNA, 19 bp, Homo sapiens
attttgaaaaaaacagaaa

SEQ ID NO: 5176 - DNA, 19 bp, Homo sapiens
ttccatcacaaatcctttg

SEQ ID NO: 5177 - DNA, 19 bp, Homo sapiens
actttacttcccaactctc

SEQ ID NO: 5178 - DNA, 19 bp, Homo sapiens
aactttacttcccaactct

SEQ ID NO: 5179 - DNA, 19 bp, Homo sapiens
ttgattcccttttttgaga

SEQ ID NO: 5180 - DNA, 19 bp, Homo sapiens
tgctgaatccaaaagattg

SEQ ID NO: 5181 - DNA, 19 bp, Homo sapiens
ggtttatcaaggggccatt

SEQ ID NO: 5182 - DNA, 19 bp, Homo sapiens
aggttccatcgtgcaaact

SEQ ID NO: 5183 - DNA, 19 bp, Homo sapiens
tgctccaggagaacttact

SEQ ID NO: 5184 - DNA, 19 bp, Homo sapiens
aactctcaagtcaagttga

SEQ ID NO: 5185 - DNA, 19 bp, Homo sapiens
tccattctgaatatattgt

SEQ ID NO: 5186 - DNA, 19 bp, Homo sapiens
attttctgaacttccccag

SEQ ID NO: 5187 - DNA, 19 bp, Homo sapiens
atctgatgaggaaactcag

SEQ ID NO: 5188 - DNA, 19 bp, Homo sapiens
ttcatgtccctagaaatct

SEQ ID NO: 5189 - DNA, 19 bp, Homo sapiens
tcaaggataacgtgtttga

SEQ ID NO: 5190 - DNA, 19 bp, Homo sapiens
ttgatgatgctgtcaagaa

SEQ ID NO: 5191 - DNA, 19 bp, Homo sapiens
cgacgaagaaaataatttc

SEQ ID NO: 5192 - DNA, 19 bp, Homo sapiens
ttccagaaagcagccagtg

SEQ ID NO: 5193 - DNA, 19 bp, Homo sapiens
cttccccaaagagaccagt

SEQ ID NO: 5194 - DNA, 19 bp, Homo sapiens
ctgattactatgaaaaatt

SEQ ID NO: 5195 - DNA, 19 bp, Homo sapiens
atggaaaagggaaagagaa

SEQ ID NO: 5196 - DNA, 19 bp, Homo sapiens
tggaagtgtcagtggcaaa

SEQ ID NO: 5197 - DNA, 19 bp, Homo sapiens
aggacctttcaaattcctg

SEQ ID NO: 5198 - DNA, 19 bp, Homo sapiens
aaatcaggatctgagttat

SEQ ID NO: 5199 - DNA, 19 bp, Homo sapiens
tccattctgaatatattgt

SEQ ID NO: 5200 - DNA, 19 bp, Homo sapiens
tgctggaattgtcattcct

SEQ ID NO: 5201 - DNA, 19 bp, Homo sapiens
taagttctctgtacctgct

SEQ ID NO: 5202 - DNA, 19 bp, Homo sapiens
ttcaaaacgagcttcagga

SEQ ID NO: 5203 - DNA, 19 bp, Homo sapiens
catttgatttaagtgtaaa

SEQ ID NO: 5204 - DNA, 19 bp, Homo sapiens
ggagacagcatcttcgtgt

SEQ ID NO: 5205 - DNA, 19 bp, Homo sapiens
tcccagaaaacctcttctt

SEQ ID NO: 5206 - DNA, 19 bp, Homo sapiens
ccttttacaattcattttc

SEQ ID NO: 5207 - DNA, 19 bp, Homo sapiens
ttttgagaatgaatttcaa

SEQ ID NO: 5208 - DNA, 19 bp, Homo sapiens
gttttggctgataaattca

SEQ ID NO: 5209 - DNA, 19 bp, Homo sapiens
gtttgataagtacaaagct

SEQ ID NO: 5210 - DNA, 19 bp, Homo sapiens
tgcctgagcagaccattga

SEQ ID NO: 5211 - DNA, 19 bp, Homo sapiens
aactttgcactatgttcat

SEQ ID NO: 5212 - DNA, 19 bp, Homo sapiens
aacacatgaatcacaaatt

SEQ ID NO: 5213 - DNA, 19 bp, Homo sapiens
tcaaaacgagcttcaggaa

SEQ ID NO: 5214 - DNA, 19 bp, Homo sapiens
atgggaagtataagaactt

SEQ ID NO: 5215 - DNA, 19 bp, Homo sapiens
agaaaaggcacaccttgac

SEQ ID NO: 5216 - DNA, 19 bp, Homo sapiens
gtaagaaaatacagagcag

SEQ ID NO: 5217 - DNA, 19 bp, Homo sapiens
agttgaaggagactattca

SEQ ID NO: 5218 - DNA, 19 bp, Homo sapiens
aaggaaacataaactaata

SEQ ID NO: 5219 - DNA, 19 bp, Homo sapiens
agaagaaatctgcagaaca

SEQ ID NO: 5220 - DNA, 19 bp, Homo sapiens
gcagtagactataagcaga

SEQ ID NO: 5221 - DNA, 19 bp, Homo sapiens
ctcagggatctgaaggtgg

SEQ ID NO: 5222 - DNA, 19 bp, Homo sapiens
atgaagtagaccaacaaat

SEQ ID NO: 5223 - DNA, 19 bp, Homo sapiens
gccacactccaacgcatat

SEQ ID NO: 5224 - DNA, 19 bp, Homo sapiens
ttttacaattcattttcca

SEQ ID NO: 5225 - DNA, 19 bp, Homo sapiens
agacctagtgattacactt

SEQ ID NO: 5226 - DNA, 19 bp, Homo sapiens
ccatgcaagtcagcccagt

SEQ ID NO: 5227 - DNA, 19 bp, Homo sapiens
ttaatcgagaggtatgaag

SEQ ID NO: 5228 - DNA, 19 bp, Homo sapiens
gagttgagggtccgggaat

SEQ ID NO: 5229 - DNA, 19 bp, Human hepatitis C virus
ttttttttttttttttttt

SEQ ID NO: 5230 - DNA, 19 bp, Human hepatitis C virus
ttttttttttttttttttt

SEQ ID NO: 5231 - DNA, 19 bp, Homo sapiens
aagcgcacctcaatatcaa

SEQ ID NO: 5232 - DNA, 19 bp, Homo sapiens
ggaactattgctagtgagg

SEQ ID NO: 5233 - DNA, 19 bp, Homo sapiens
ttgggaagaagaggcagct

SEQ ID NO: 5234 - DNA, 19 bp, Homo sapiens
gatatacactagggaggaa

SEQ ID NO: 5235 - DNA, 19 bp, Homo sapiens
gcttggttttgccagtctc

SEQ ID NO: 5236 - DNA, 19 bp, Homo sapiens
aagaggtatttaaagccat

SEQ ID NO: 5237 - DNA, 19 bp, Homo sapiens
caagaggtatttaaagcca

SEQ ID NO: 5238 - DNA, 19 bp, Homo sapiens
cttgggggaggaggaacaa

SEQ ID NO: 5239 - DNA, 19 bp, Homo sapiens
acttgggggaggaggaaca

SEQ ID NO: 5240 - DNA, 19 bp, Homo sapiens
ggaatctgatgaggaaact

SEQ ID NO: 5241 - DNA, 19 bp, Homo sapiens
ctggatgtaaccaccagca

SEQ ID NO: 5242 - DNA, 19 bp, Homo sapiens
tgatcaagaacctgttagt

SEQ ID NO: 5243 - DNA, 19 bp, Homo sapiens
ctgatcaagaacctgttag

SEQ ID NO: 5244 - DNA, 19 bp, Homo sapiens
ttttcagaccaactctctg

SEQ ID NO: 5245 - DNA, 19 bp, Homo sapiens
gaatttgaaagttcgtttt

SEQ ID NO: 5246 - DNA, 19 bp, Homo sapiens
gaaaacctatgccttaatc

SEQ ID NO: 5247 - DNA, 19 bp, Homo sapiens
tcaaaacctactgtctctt

SEQ ID NO: 5248 - DNA, 19 bp, Homo sapiens
aggacaccaaaataacctt

SEQ ID NO: 5249 - DNA, 19 bp, Homo sapiens
tgtcaacaagtaccactgg

SEQ ID NO: 5250 - DNA, 19 bp, Homo sapiens
gtttttaaattgttgaaag

SEQ ID NO: 5251 - DNA, 19 bp, Homo sapiens
aaaagggtcatggaaatgg

SEQ ID NO: 5252 - DNA, 19 bp, Homo sapiens
aagatagtcagtctgatca

SEQ ID NO: 5253 - DNA, 19 bp, Homo sapiens
atgagatcaacacaatctt

SEQ ID NO: 5254 - DNA, 19 bp, Homo sapiens
ttggtacgagttactcaaa

SEQ ID NO: 5255 - DNA, 19 bp, Homo sapiens
ctcaattttgattttcaag

SEQ ID NO: 5256 - DNA, 19 bp, Homo sapiens
cactcattgattttctgaa

SEQ ID NO: 5257 - DNA, 19 bp, Homo sapiens
agcagattatgttgaaaca

SEQ ID NO: 5258 - DNA, 19 bp, Homo sapiens
tcttttcagcccagccatt

SEQ ID NO: 5259 - DNA, 19 bp, Homo sapiens
atctgatgaggaaactcag

SEQ ID NO: 5260 - DNA, 19 bp, Homo sapiens
aatctgatgaggaaactca

SEQ ID NO: 5261 - DNA, 19 bp, Homo sapiens
ttaatcttcataagttcaa

SEQ ID NO: 5262 - DNA, 19 bp, Homo sapiens
tcaattgggagagacaagt

SEQ ID NO: 5263 - DNA, 19 bp, Homo sapiens
ctgagaacttcatcatttg

SEQ ID NO: 5264 - DNA, 19 bp, Homo sapiens
gatccaagtatagttggct

SEQ ID NO: 5265 - DNA, 19 bp, Homo sapiens
tggacctgcaccaaagctg

SEQ ID NO: 5266 - DNA, 19 bp, Homo sapiens
tctgatatacatcacggag

SEQ ID NO: 5267 - DNA, 19 bp, Homo sapiens
ttgagttgcccaccatcat

SEQ ID NO: 5268 - DNA, 19 bp, Homo sapiens
agcaagtctttcctggcct

SEQ ID NO: 5269 - DNA, 19 bp, Homo sapiens
ttgggagagacaagtttca

SEQ ID NO: 5270 - DNA, 19 bp, Homo sapiens
actttgcactatgttcata

SEQ ID NO: 5271 - DNA, 19 bp, Homo sapiens
atcaacacaatcttcaatg

SEQ ID NO: 5272 - DNA, 19 bp, Homo sapiens
cttggtacgagttactcaa

SEQ ID NO: 5273 - DNA, 19 bp, Homo sapiens
agtgattacacttcctttc

SEQ ID NO: 5274 - DNA, 19 bp, Homo sapiens
tttctgccactgctcagga

SEQ ID NO: 5275 - DNA, 19 bp, Homo sapiens
tcttccgttctgtaatggc

SEQ ID NO: 5276 - DNA, 19 bp, Homo sapiens
cctgcaccaaagctggcac

SEQ ID NO: 5277 - DNA, 19 bp, Homo sapiens
aatttattcaaaacgagct

SEQ ID NO: 5278 - DNA, 19 bp, Homo sapiens
ttaaaagaaatcttcaatt

SEQ ID NO: 5279 - DNA, 19 bp, Homo sapiens
ttctctctatgggaaaaaa

SEQ ID NO: 5280 - DNA, 19 bp, Homo sapiens
attgagattccctccatta

SEQ ID NO: 5281 - DNA, 19 bp, Homo sapiens
tataagcagaagcacatat

SEQ ID NO: 5282 - DNA, 19 bp, Homo sapiens
tcaaccttaatgattttca

SEQ ID NO: 5283 - DNA, 19 bp, Homo sapiens
tattcttcttttccaattg

SEQ ID NO: 5284 - DNA, 19 bp, Homo sapiens
gaaatcttcaatttattct

SEQ ID NO: 5285 - DNA, 19 bp, Homo sapiens
atcagttcagataaacttc

SEQ ID NO: 5286 - DNA, 19 bp, Homo sapiens
ttttgagaatgaatttcaa

SEQ ID NO: 5287 - DNA, 19 bp, Homo sapiens
aaattccttgacatgttga

SEQ ID NO: 5288 - DNA, 19 bp, Homo sapiens
gaagtgtcagtggcaaaaa

SEQ ID NO: 5289 - DNA, 19 bp, Homo sapiens
gcaagggttcactgttcct

SEQ ID NO: 5290 - DNA, 19 bp, Homo sapiens
ctccccaggacctttcaaa

SEQ ID NO: 5291 - DNA, 19 bp, Homo sapiens
tccatcttcaggaagctgt

SEQ ID NO: 5292 - DNA, 19 bp, Homo sapiens
ccatcttcaggaagctgtg

SEQ ID NO: 5293 - DNA, 19 bp, Homo sapiens
cctctggccatgccatggg

SEQ ID NO: 5294 - DNA, 19 bp, Homo sapiens
ctctggccatgccatgggc

SEQ ID NO: 5295 - DNA, 19 bp, Homo sapiens
ttgaatgtcattttgtggt

SEQ ID NO: 5296 - DNA, 19 bp, Homo sapiens
tcagtaatgggggaccagc

SEQ ID NO: 5297 - DNA, 19 bp, Homo sapiens
ttttactgtgcatacatgt

SEQ ID NO: 5298 - DNA, 19 bp, Homo sapiens
tgaggtgccaaggaaatga

SEQ ID NO: 5299 - DNA, 19 bp, Homo sapiens
gaggtgccaaggaaatgag

SEQ ID NO: 5300 - DNA, 19 bp, Homo sapiens
gggaaagataaagccgacc

SEQ ID NO: 5301 - DNA, 19 bp, Homo sapiens
ttttcctcatcaagttgtt

SEQ ID NO: 5302 - DNA, 19 bp, Homo sapiens
ctttcagccacatccacag

SEQ ID NO: 5303 - DNA, 19 bp, Homo sapiens
tggactctggagaaagccc

SEQ ID NO: 5304 - DNA, 19 bp, Homo sapiens
agcctcctcaagaacctgg

SEQ ID NO: 5305 - DNA, 19 bp, Homo sapiens
ggcctggggctggctctca

SEQ ID NO: 5306 - DNA, 19 bp, Homo sapiens
gagctcactcccactggaa

SEQ ID NO: 5307 - DNA, 19 bp, Homo sapiens
agctaatgaagctattgag

SEQ ID NO: 5308 - DNA, 19 bp, Homo sapiens
gctaatgaagctattgaga

SEQ ID NO: 5309 - DNA, 19 bp, Homo sapiens
ctaaatggctttaattata

SEQ ID NO: 5310 - DNA, 19 bp, Homo sapiens
ctgcttttctttttttttc

SEQ ID NO: 5311 - DNA, 19 bp, Homo sapiens
caatcaccaccaagcctgg

SEQ ID NO: 5312 - DNA, 19 bp, Homo sapiens
agcctggaataactgcaag

SEQ ID NO: 5313 - DNA, 19 bp, Homo sapiens
gttccatcttcaggaagct

SEQ ID NO: 5314 - DNA, 19 bp, Homo sapiens
tggtgggttttggatactg

SEQ ID NO: 5315 - DNA, 19 bp, Homo sapiens
acctgtgagactggaccag

SEQ ID NO: 5316 - DNA, 19 bp, Homo sapiens
gctgttacagaaactttca

SEQ ID NO: 5317 - DNA, 19 bp, Homo sapiens
acagcatctataatgccag

SEQ ID NO: 5318 - DNA, 19 bp, Homo sapiens
gggtgtagacctcctgtgg

SEQ ID NO: 5319 - DNA, 19 bp, Homo sapiens
ggtgtagacctcctgtgga

SEQ ID NO: 5320 - DNA, 19 bp, Homo sapiens
gtgtagacctcctgtggac

SEQ ID NO: 5321 - DNA, 19 bp, Homo sapiens
gacctcctgtggactctgg

SEQ ID NO: 5322 - DNA, 19 bp, Homo sapiens
cctgggcacgctctttggc

SEQ ID NO: 5323 - DNA, 19 bp, Homo sapiens
ctgggcacgctctttggcc

SEQ ID NO: 5324 - DNA, 19 bp, Homo sapiens
ctggtcttctacgtcttgt

SEQ ID NO: 5325 - DNA, 19 bp, Homo sapiens
agagtgcggtagtgcccct

SEQ ID NO: 5326 - DNA, 19 bp, Homo sapiens
tgggcactggtatttggag

SEQ ID NO: 5327 - DNA, 19 bp, Homo sapiens
gaattaaatcacggatggc

SEQ ID NO: 5328 - DNA, 19 bp, Homo sapiens
tgttgctagaagttgggtt

SEQ ID NO: 5329 - DNA, 19 bp, Homo sapiens
aggagctctgaatctgata

SEQ ID NO: 5330 - DNA, 19 bp, Homo sapiens
taaatggctttaattatat

SEQ ID NO: 5331 - DNA, 19 bp, Homo sapiens
aaaatgacaaggggagggc

SEQ ID NO: 5332 - DNA, 19 bp, Homo sapiens
ttaaaggaaaagtcaacat

SEQ ID NO: 5333 - DNA, 19 bp, Homo sapiens
acatcttctctcttttttt

SEQ ID NO: 5334 - DNA, 19 bp, Homo sapiens
ttctacgtcctcttcccca

SEQ ID NO: 5335 - DNA, 19 bp, Homo sapiens
tgggtagctgtgattggag

SEQ ID NO: 5336 - DNA, 19 bp, Homo sapiens
gctgtgattggagactggc

SEQ ID NO: 5337 - DNA, 19 bp, Homo sapiens
cacttccgtgcccctgata

SEQ ID NO: 5338 - DNA, 19 bp, Homo sapiens
acatctactctttccatct

SEQ ID NO: 5339 - DNA, 19 bp, Homo sapiens
ctactctttccatctttca

SEQ ID NO: 5340 - DNA, 19 bp, Homo sapiens
agataaagccgacctacag

SEQ ID NO: 5341 - DNA, 19 bp, Homo sapiens
tgtgcagctgaatgtctgt

SEQ ID NO: 5342 - DNA, 19 bp, Homo sapiens
atgtctgtctgtcacgaat

SEQ ID NO: 5343 - DNA, 19 bp, Homo sapiens
ctgtcacgaatctaccttg

SEQ ID NO: 5344 - DNA, 19 bp, Homo sapiens
atcaagttgttgctggagt

SEQ ID NO: 5345 - DNA, 19 bp, Homo sapiens
cagaaactttcagccacat

SEQ ID NO: 5346 - DNA, 19 bp, Homo sapiens
actttcagccacatccaca

SEQ ID NO: 5347 - DNA, 19 bp, Homo sapiens
atgccagcctcaagaaata

SEQ ID NO: 5348 - DNA, 19 bp, Homo sapiens
agaaatattttctcattac

SEQ ID NO: 5349 - DNA, 19 bp, Homo sapiens
gaaatattttctcattacc

SEQ ID NO: 5350 - DNA, 19 bp, Homo sapiens
tgctgctcaagggactggg

SEQ ID NO: 5351 - DNA, 19 bp, Homo sapiens
cctgtggactctggagaaa

SEQ ID NO: 5352 - DNA, 19 bp, Homo sapiens
ggagaaagcccagaggtgg

SEQ ID NO: 5353 - DNA, 19 bp, Homo sapiens
ttgaaacccccatcccaag

SEQ ID NO: 5354 - DNA, 19 bp, Homo sapiens
cagatggaggtgccatatc

SEQ ID NO: 5355 - DNA, 19 bp, Homo sapiens
ggagctcactcccactgga

SEQ ID NO: 5356 - DNA, 19 bp, Homo sapiens
ttgggtaatgtttttgaaa

SEQ ID NO: 5357 - DNA, 19 bp, Homo sapiens
gaagttgggttgttctgga

SEQ ID NO: 5358 - DNA, 19 bp, Homo sapiens
aaaagaaggctgcctaagg

SEQ ID NO: 5359 - DNA, 19 bp, Homo sapiens
aaagaaggctgcctaagga

SEQ ID NO: 5360 - DNA, 19 bp, Homo sapiens
aagaaggctgcctaaggag

SEQ ID NO: 5361 - DNA, 19 bp, Homo sapiens
agaaggctgcctaaggagg

SEQ ID NO: 5362 - DNA, 19 bp, Homo sapiens
atttccttggatttctgaa

SEQ ID NO: 5363 - DNA, 19 bp, Homo sapiens
tccttataagcccagctct

SEQ ID NO: 5364 - DNA, 19 bp, Homo sapiens
ataagcccagctctgcttt

SEQ ID NO: 5365 - DNA, 19 bp, Homo sapiens
ggccaggattcctctctca

SEQ ID NO: 5366 - DNA, 19 bp, Homo sapiens
gccaactcctccttgcctg

SEQ ID NO: 5367 - DNA, 19 bp, Homo sapiens
ttttttttctttttttgag

SEQ ID NO: 5368 - DNA, 19 bp, Homo sapiens
ccggcgtgcaccaccatgc

SEQ ID NO: 5369 - DNA, 19 bp, Homo sapiens
acagactctttcagatgga

SEQ ID NO: 5370 - DNA, 19 bp, Homo sapiens
cacagactctttcagatgg

SEQ ID NO: 5371 - DNA, 19 bp, Homo sapiens
cccattttgaggccagagg

SEQ ID NO: 5372 - DNA, 19 bp, Homo sapiens
gcccattttgaggccagag

SEQ ID NO: 5373 - DNA, 19 bp, Homo sapiens
accatacattatcattcaa

SEQ ID NO: 5374 - DNA, 19 bp, Homo sapiens
gctggtctcgaactcctga

SEQ ID NO: 5375 - DNA, 19 bp, Homo sapiens
acatctttgaaaagaaaaa

SEQ ID NO: 5376 - DNA, 19 bp, Homo sapiens
tcatgtctcagcctcctca

SEQ ID NO: 5377 - DNA, 19 bp, Homo sapiens
ctcatgtctcagcctcctc

SEQ ID NO: 5378 - DNA, 19 bp, Homo sapiens
ggtcgcctggcttattccc

SEQ ID NO: 5379 - DNA, 19 bp, Homo sapiens
aacatctttgaaaagaaaa

SEQ ID NO: 5380 - DNA, 19 bp, Homo sapiens
ctgtggactctggagaaag

SEQ ID NO: 5381 - DNA, 19 bp, Homo sapiens
gggctggctctcaactcca

SEQ ID NO: 5382 - DNA, 19 bp, Homo sapiens
ccagattcttccactggct

SEQ ID NO: 5383 - DNA, 19 bp, Homo sapiens
tgagccaccgcaccgggcc

SEQ ID NO: 5384 - DNA, 19 bp, Homo sapiens
ttccaggtagggccagctc

SEQ ID NO: 5385 - DNA, 19 bp, Homo sapiens
ctcagcctcctcagtagct

SEQ ID NO: 5386 - DNA, 19 bp, Homo sapiens
tctcagcctcctcagtagc

SEQ ID NO: 5387 - DNA, 19 bp, Homo sapiens
tatatttttagaattttag

SEQ ID NO: 5388 - DNA, 19 bp, Homo sapiens
gaaaaatatatatgtgcag

SEQ ID NO: 5389 - DNA, 19 bp, Homo sapiens
ccagaatgggtccacattg

SEQ ID NO: 5390 - DNA, 19 bp, Homo sapiens
cttggatttctgaatggct

SEQ ID NO: 5391 - DNA, 19 bp, Homo sapiens
agctcactcccactggaac

SEQ ID NO: 5392 - DNA, 19 bp, Homo sapiens
cagtcctcccaccctacca

SEQ ID NO: 5393 - DNA, 19 bp, Homo sapiens
ctggagaaagcccagaggt

SEQ ID NO: 5394 - DNA, 19 bp, Homo sapiens
tgaatggtcttctgccagc

SEQ ID NO: 5395 - DNA, 19 bp, Homo sapiens
ctgggtgtagacctcctgt

SEQ ID NO: 5396 - DNA, 19 bp, Homo sapiens
ccacattgacaccacaccc

SEQ ID NO: 5397 - DNA, 19 bp, Homo sapiens
tccacattgacaccacacc

SEQ ID NO: 5398 - DNA, 19 bp, Homo sapiens
gtccacattgacaccacac

SEQ ID NO: 5399 - DNA, 19 bp, Homo sapiens
ccagatattgcactaggtc

SEQ ID NO: 5400 - DNA, 19 bp, Homo sapiens
gccagctcacaagcccagg

SEQ ID NO: 5401 - DNA, 19 bp, Homo sapiens
ggccagctcacaagcccag

SEQ ID NO: 5402 - DNA, 19 bp, Homo sapiens
acaaaagcaagacttccag

SEQ ID NO: 5403 - DNA, 19 bp, Homo sapiens
agggccaggattcctctct

SEQ ID NO: 5404 - DNA, 19 bp, Homo sapiens
ctcccactggaacagccca

SEQ ID NO: 5405 - DNA, 19 bp, Homo sapiens
gccaaccaagagcacattc

SEQ ID NO: 5406 - DNA, 19 bp, Homo sapiens
aaccatcctgctcataaca

SEQ ID NO: 5407 - DNA, 19 bp, Homo sapiens
tatcacattacatcatcct

SEQ ID NO: 5408 - DNA, 19 bp, Homo sapiens
atatatgtgcagtatttta

SEQ ID NO: 5409 - DNA, 19 bp, Homo sapiens
gccctccttgcctgttttt

SEQ ID NO: 5410 - DNA, 19 bp, Homo sapiens
atgtgcagtattttattaa

SEQ ID NO: 5411 - DNA, 19 bp, Homo sapiens
aaaagaaaaatatatatgt

SEQ ID NO: 5412 - DNA, 19 bp, Homo sapiens
tgggccagccgcacaagaa

SEQ ID NO: 5413 - DNA, 19 bp, Homo sapiens
ctcccactggaacagccca

SEQ ID NO: 5414 - DNA, 19 bp, Homo sapiens
gccatgccatgggcacagc

SEQ ID NO: 5415 - DNA, 19 bp, Homo sapiens
tatcacccaggctggagtg

SEQ ID NO: 5416 - DNA, 19 bp, Homo sapiens
agatgggatttcatcatgt

SEQ ID NO: 5417 - DNA, 19 bp, Homo sapiens
tgaatactctcacaagtag

SEQ ID NO: 5418 - DNA, 19 bp, Homo sapiens
ctgtttttcaatctcatct

SEQ ID NO: 5419 - DNA, 19 bp, Homo sapiens
acagaaactttcagccaca

SEQ ID NO: 5420 - DNA, 19 bp, Homo sapiens
attcaggtatagctgacat

SEQ ID NO: 5421 - DNA, 19 bp, Homo sapiens
caaggtgctaggattacag

SEQ ID NO: 5422 - DNA, 19 bp, Homo sapiens
actcctgacctcaagtgat

SEQ ID NO: 5423 - DNA, 19 bp, Homo sapiens
atgtttcaattaggctctg

SEQ ID NO: 5424 - DNA, 19 bp, Homo sapiens
tgtggcgtatcatgcaagt

SEQ ID NO: 5425 - DNA, 19 bp, Homo sapiens
tattttttttactgtgcat

SEQ ID NO: 5426 - DNA, 19 bp, Homo sapiens
gtaaatatgactcctttct

SEQ ID NO: 5427 - DNA, 19 bp, Homo sapiens
ggtaaatatgactcctttc

SEQ ID NO: 5428 - DNA, 19 bp, Homo sapiens
cccaagccaaccaagagca

SEQ ID NO: 5429 - DNA, 19 bp, Homo sapiens
tttcatcatgttggccagg

SEQ ID NO: 5430 - DNA, 19 bp, Homo sapiens
ccaccgcaccgggccctcc

SEQ ID NO: 5431 - DNA, 19 bp, Homo sapiens
cttgaattcctgggctcaa

SEQ ID NO: 5432 - DNA, 19 bp, Homo sapiens
gatatgcagagtatttctg

SEQ ID NO: 5433 - DNA, 19 bp, Homo sapiens
tccacctgccttggcctcc

SEQ ID NO: 5434 - DNA, 19 bp, Homo sapiens
tttctctatcccaagccaa

SEQ ID NO: 5435 - DNA, 19 bp, Homo sapiens
tccaccccactggatcttc

SEQ ID NO: 5436 - DNA, 19 bp, Homo sapiens
ccttgcctgcttttctttt

SEQ ID NO: 5437 - DNA, 19 bp, Homo sapiens
tccttgcctgcttttcttt

SEQ ID NO: 5438 - DNA, 19 bp, Homo sapiens
ctccttgcctgcttttctt

SEQ ID NO: 5439 - DNA, 19 bp, Homo sapiens
cctccttgcctgcttttct

SEQ ID NO: 5440 - DNA, 19 bp, Homo sapiens
ttcaattaggctctgaaat

SEQ ID NO: 5441 - DNA, 19 bp, Homo sapiens
agagcacattcttaaagga

SEQ ID NO: 5442 - DNA, 19 bp, Homo sapiens
aaagctgaagcctatttat

SEQ ID NO: 5443 - DNA, 19 bp, Homo sapiens
tgagccaccgcaccgggcc

SEQ ID NO: 5444 - DNA, 19 bp, Homo sapiens
caggctggagtggagtggc

SEQ ID NO: 5445 - DNA, 19 bp, Homo sapiens
ctcataacatctttgaaaa

SEQ ID NO: 5446 - DNA, 19 bp, Homo sapiens
gcatgagccaccgcaccgg

SEQ ID NO: 5447 - DNA, 19 bp, Rattus norvegicus
ctgactattacagcaacag

SEQ ID NO: 5448 - DNA, 19 bp, Rattus norvegicus
ctcttggggttggggctgg

SEQ ID NO: 5449 - DNA, 19 bp, Rattus norvegicus
tgcaaaggagaactgcgca

SEQ ID NO: 5450 - DNA, 19 bp, Rattus norvegicus
cctcgggccatgccatggg

SEQ ID NO: 5451 - DNA, 19 bp, Rattus norvegicus
ttgagcaaaccatatgcaa

SEQ ID NO: 5452 - DNA, 19 bp, Rattus norvegicus
cagcttcctgaggtaccaa

SEQ ID NO: 5453 - DNA, 19 bp, Rattus norvegicus
ggtaccaaggaggaaggat

SEQ ID NO: 5454 - DNA, 19 bp, Rattus norvegicus
ctccacgactttgggatcc

SEQ ID NO: 5455 - DNA, 19 bp, Rattus norvegicus
caggactggtttgtcttgg

SEQ ID NO: 5456 - DNA, 19 bp, Rattus norvegicus
cttctatgtcctctttccc

SEQ ID NO: 5457 - DNA, 19 bp, Rattus norvegicus
ttctatgtcctctttccca

SEQ ID NO: 5458 - DNA, 19 bp, Rattus norvegicus
tggttccacattcaagaga

SEQ ID NO: 5459 - DNA, 19 bp, Rattus norvegicus
tgcctctgataaaacagtt

SEQ ID NO: 5460 - DNA, 19 bp, Rattus norvegicus
agcccggctcctgggacag

SEQ ID NO: 5461 - DNA, 19 bp, Rattus norvegicus
agtctctgacacaagtcag

SEQ ID NO: 5462 - DNA, 19 bp, Rattus norvegicus
aaaaaggtgaatttttaaa

SEQ ID NO: 5463 - DNA, 19 bp, Rattus norvegicus
acactctcaataatgatag

SEQ ID NO: 5464 - DNA, 19 bp, Rattus norvegicus
aaagaatgaacgtgctcca

SEQ ID NO: 5465 - DNA, 19 bp, Rattus norvegicus
ctttgggatccagtcgact

SEQ ID NO: 5466 - DNA, 19 bp, Rattus norvegicus
gtgatcgctgacctcagga

SEQ ID NO: 5467 - DNA, 19 bp, Rattus norvegicus
ggaacgccttctatgtcct

SEQ ID NO: 5468 - DNA, 19 bp, Rattus norvegicus
gactgtgggcatcaatctc

SEQ ID NO: 5469 - DNA, 19 bp, Rattus norvegicus
ggacactgactattacagc

SEQ ID NO: 5470 - DNA, 19 bp, Rattus norvegicus
aagcccccgtcccagattg

SEQ ID NO: 5471 - DNA, 19 bp, Rattus norvegicus
ctgtggctgaaactttcag

SEQ ID NO: 5472 - DNA, 19 bp, Rattus norvegicus
ccagcatgtaccgcaagag

SEQ ID NO: 5473 - DNA, 19 bp, Rattus norvegicus
tgcgaccgtcccctttgca

SEQ ID NO: 5474 - DNA, 19 bp, Rattus norvegicus
cccagtgtggggccagagg

SEQ ID NO: 5475 - DNA, 19 bp, Rattus norvegicus
ttgcagagtgtgtcttcaa

SEQ ID NO: 5476 - DNA, 19 bp, Rattus norvegicus
ttggtgtctgtgatcgctg

SEQ ID NO: 5477 - DNA, 19 bp, Rattus norvegicus
atccagtcgactcgctacc

SEQ ID NO: 5478 - DNA, 19 bp, Rattus norvegicus
ggatcgggaggagggggag

SEQ ID NO: 5479 - DNA, 19 bp, Rattus norvegicus
ccaagcccgactgtgcctg

SEQ ID NO: 5480 - DNA, 19 bp, Rattus norvegicus
gggacagacacacaagaag

SEQ ID NO: 5481 - DNA, 19 bp, Rattus norvegicus
tgggacagacacacaagaa

SEQ ID NO: 5482 - DNA, 19 bp, Rattus norvegicus
tctcaataatgatagacca

SEQ ID NO: 5483 - DNA, 19 bp, Rattus norvegicus
aactctgagatcttgggca

SEQ ID NO: 5484 - DNA, 19 bp, Rattus norvegicus
ctgtcctccagcctgggct

SEQ ID NO: 5485 - DNA, 19 bp, Rattus norvegicus
ctgaatggtaatggtgact

SEQ ID NO: 5486 - DNA, 19 bp, Rattus norvegicus
tttattaaaacgacatttt

SEQ ID NO: 5487 - DNA, 19 bp, Rattus norvegicus
ctatgaatgatgcctgtgt

SEQ ID NO: 5488 - DNA, 19 bp, Rattus norvegicus
tggacctcctgtggacttt

SEQ ID NO: 5489 - DNA, 19 bp, Rattus norvegicus
agtcagcggccgtgcaaag

SEQ ID NO: 5490 - DNA, 19 bp, Rattus norvegicus
tcctctctccaaaggtcac

SEQ ID NO: 5491 - DNA, 19 bp, Rattus norvegicus
aggactcatcactgcttcc

SEQ ID NO: 5492 - DNA, 19 bp, Rattus norvegicus
gagactggaccagggagtc

SEQ ID NO: 5493 - DNA, 19 bp, Rattus norvegicus
gctgaacgtctgtctgtcc

SEQ ID NO: 5494 - DNA, 19 bp, Rattus norvegicus
caattgtttgctggtgctt

SEQ ID NO: 5495 - DNA, 19 bp, Homo sapiens
agcagcttcagtccccgcc

SEQ ID NO: 5496 - DNA, 19 bp, Homo sapiens
ccattctggtgccactacc

SEQ ID NO: 5497 - DNA, 19 bp, Homo sapiens
tccttctctgagtggtaaa

SEQ ID NO: 5498 - DNA, 19 bp, Homo sapiens
tctgagtggtaaaggcaat

SEQ ID NO: 5499 - DNA, 19 bp, Homo sapiens
cagagggtacgagctgcta

SEQ ID NO: 5500 - DNA, 19 bp, Homo sapiens
ctaaatgacgaggaccagg

SEQ ID NO: 5501 - DNA, 19 bp, Homo sapiens
taaatgacgaggaccaggt

SEQ ID NO: 5502 - DNA, 19 bp, Homo sapiens
gtcctgtatgagtgggaac

SEQ ID NO: 5503 - DNA, 19 bp, Homo sapiens
cccagcgccgtacgtccat

SEQ ID NO: 5504 - DNA, 19 bp, Homo sapiens
tcccctgagggtatttgaa

SEQ ID NO: 5505 - DNA, 19 bp, Homo sapiens
gggtatttgaagtatacca

SEQ ID NO: 5506 - DNA, 19 bp, Homo sapiens
gctgttagtcactggcagc

SEQ ID NO: 5507 - DNA, 19 bp, Homo sapiens
gtcctgtatgagtgggaac

SEQ ID NO: 5508 - DNA, 19 bp, Homo sapiens
tcctgtatgagtgggaaca

SEQ ID NO: 5509 - DNA, 19 bp, Homo sapiens
gtatgcaatgactcgagct

SEQ ID NO: 5510 - DNA, 19 bp, Homo sapiens
gtccagcgtttggctgaac

SEQ ID NO: 5511 - DNA, 19 bp, Homo sapiens
tatcaagatgatgcagaac

SEQ ID NO: 5512 - DNA, 19 bp, Homo sapiens
tatggtccatcagctttct

SEQ ID NO: 5513 - DNA, 19 bp, Homo sapiens
ccctggtgaaaatgcttgg

SEQ ID NO: 5514 - DNA, 19 bp, Homo sapiens
agctttaggacttcacctg

SEQ ID NO: 5515 - DNA, 19 bp, Homo sapiens
ggaatctttcagatgctgc

SEQ ID NO: 5516 - DNA, 19 bp, Homo sapiens
tgtccttcgggctggtgac

SEQ ID NO: 5517 - DNA, 19 bp, Homo sapiens
cacagctcctctgacagag

SEQ ID NO: 5518 - DNA, 19 bp, Homo sapiens
ccagacagaaaagcggctg

SEQ ID NO: 5519 - DNA, 19 bp, Homo sapiens
cagcagcgttggcccggcc

SEQ ID NO: 5520 - DNA, 19 bp, Homo sapiens
aggtctgaggagcagcttc

SEQ ID NO: 5521 - DNA, 19 bp, Homo sapiens
actgttttgaaaatccagc

SEQ ID NO: 5522 - DNA, 19 bp, Homo sapiens
ctgatttgatggagttgga

SEQ ID NO: 5523 - DNA, 19 bp, Homo sapiens
ccagacagaaaagcggctg

SEQ ID NO: 5524 - DNA, 19 bp, Homo sapiens
acagctccttctctgagtg

SEQ ID NO: 5525 - DNA, 19 bp, Homo sapiens
tggatacctcccaagtcct

SEQ ID NO: 5526 - DNA, 19 bp, Homo sapiens
tcaagaacaagtagctgat

SEQ ID NO: 5527 - DNA, 19 bp, Homo sapiens
agctcagagggtacgagct

SEQ ID NO: 5528 - DNA, 19 bp, Homo sapiens
gcatgcagatcccatctac

SEQ ID NO: 5529 - DNA, 19 bp, Homo sapiens
ccacacgtgcaatccctga

SEQ ID NO: 5530 - DNA, 19 bp, Homo sapiens
cacacgtgcaatccctgaa

SEQ ID NO: 5531 - DNA, 19 bp, Homo sapiens
ggaccttgcataacctttc

SEQ ID NO: 5532 - DNA, 19 bp, Homo sapiens
ctccacaaccttttattac

SEQ ID NO: 5533 - DNA, 19 bp, Homo sapiens
cagagtgctgaaggtgcta

SEQ ID NO: 5534 - DNA, 19 bp, Homo sapiens
ggactctcaggaatctttc

SEQ ID NO: 5535 - DNA, 19 bp, Homo sapiens
tgatataaatgtggtcacc

SEQ ID NO: 5536 - DNA, 19 bp, Homo sapiens
cccagcgccgtacgtccat

SEQ ID NO: 5537 - DNA, 19 bp, Homo sapiens
gtccatgggtgggacacag

SEQ ID NO: 5538 - DNA, 19 bp, Homo sapiens
ttgtaccggagcccttcac

SEQ ID NO: 5539 - DNA, 19 bp, Homo sapiens
ttgttatcagaggactaaa

SEQ ID NO: 5540 - DNA, 19 bp, Homo sapiens
gaagctattgaagctgagg

SEQ ID NO: 5541 - DNA, 19 bp, Homo sapiens
tcagaacagagccaatggc

SEQ ID NO: 5542 - DNA, 19 bp, Homo sapiens
ggcgacatatgcagctgct

SEQ ID NO: 5543 - DNA, 19 bp, Homo sapiens
ggtatggaccccatgatgg

SEQ ID NO: 5544 - DNA, 19 bp, Homo sapiens
tttattacatcaagaagga

SEQ ID NO: 5545 - DNA, 19 bp, Homo sapiens
attgtacgtaccatgcaga

SEQ ID NO: 5546 - DNA, 19 bp, Homo sapiens
tagctgcaggggtcctctg

SEQ ID NO: 5547 - DNA, 19 bp, Homo sapiens
cctgtaaatcatcctttag

SEQ ID NO: 5548 - DNA, 19 bp, Homo sapiens
acctgtaaatcatccttta

SEQ ID NO: 5549 - DNA, 19 bp, Homo sapiens
gttccgaatgtctgaggac

SEQ ID NO: 5550 - DNA, 19 bp, Homo sapiens
atgggctgccagatctggg

SEQ ID NO: 5551 - DNA, 19 bp, Homo sapiens
ttcacatcctagctcggga

SEQ ID NO: 5552 - DNA, 19 bp, Homo sapiens
tggttaagctcttacaccc

SEQ ID NO: 5553 - DNA, 19 bp, Homo sapiens
gctgcctccaggtgacagc

SEQ ID NO: 5554 - DNA, 19 bp, Homo sapiens
gttcgccttcactatggac

SEQ ID NO: 5555 - DNA, 19 bp, Homo sapiens
tgttccgaatgtctgagga

SEQ ID NO: 5556 - DNA, 19 bp, Homo sapiens
agctggcctggtttgatac

SEQ ID NO: 5557 - DNA, 19 bp, Homo sapiens
gttcgccttcactatggac

SEQ ID NO: 5558 - DNA, 19 bp, Homo sapiens
gttcgtgcacatcaggata

SEQ ID NO: 5559 - DNA, 19 bp, Homo sapiens
agaaagcaagctcatcata

SEQ ID NO: 5560 - DNA, 19 bp, Homo sapiens
ccaaagagtagctgcaggg

SEQ ID NO: 5561 - DNA, 19 bp, Homo sapiens
caggtgacagcaatcagct

SEQ ID NO: 5562 - DNA, 19 bp, Homo sapiens
gcagctgctgttttgttcc

SEQ ID NO: 5563 - DNA, 19 bp, Homo sapiens
gtcatctgaccagccgaca

SEQ ID NO: 5564 - DNA, 19 bp, Homo sapiens
ctctaggaatgaaggtgtg

SEQ ID NO: 5565 - DNA, 19 bp, Homo sapiens
cagctcgttgtaccgctgg

SEQ ID NO: 5566 - DNA, 19 bp, Homo sapiens
ggccaccaccctggtgctg

SEQ ID NO: 5567 - DNA, 19 bp, Homo sapiens
gaagaggatgtggatacct

SEQ ID NO: 5568 - DNA, 19 bp, Homo sapiens
gctgatattgatggacagt

SEQ ID NO: 5569 - DNA, 19 bp, Homo sapiens
tccaggtgacagcaatcag

SEQ ID NO: 5570 - DNA, 19 bp, Homo sapiens
cagcaacagtcttacctgg

SEQ ID NO: 5571 - DNA, 19 bp, Homo sapiens
cactgagcctgccatctgt

SEQ ID NO: 5572 - DNA, 19 bp, Homo sapiens
aggactaaataccattcca

SEQ ID NO: 5573 - DNA, 19 bp, Homo sapiens
atcagctggcctggtttga

SEQ ID NO: 5574 - DNA, 19 bp, Homo sapiens
agctggtggaatgcaagct

SEQ ID NO: 5575 - DNA, 19 bp, Homo sapiens
gtagaagctggtggaatgc

SEQ ID NO: 5576 - DNA, 19 bp, Homo sapiens
tcagatgatataaatgtgg

SEQ ID NO: 5577 - DNA, 19 bp, Homo sapiens
ttcagatgatataaatgtg

SEQ ID NO: 5578 - DNA, 19 bp, Homo sapiens
gaaatcttgccctttgtcc

SEQ ID NO: 5579 - DNA, 19 bp, Homo sapiens
gtaaatcatcctttaggag

SEQ ID NO: 5580 - DNA, 19 bp, Homo sapiens
tagctgcaggggtcctctg

SEQ ID NO: 5581 - DNA, 19 bp, Homo sapiens
gaaatcttgccctttgtcc

SEQ ID NO: 5582 - DNA, 19 bp, Homo sapiens
ggtgacagggaagacatca

SEQ ID NO: 5583 - DNA, 19 bp, Homo sapiens
atggccaggatgccttggg

SEQ ID NO: 5584 - DNA, 19 bp, Homo sapiens
ctgtgaacttgctcaggac

SEQ ID NO: 5585 - DNA, 19 bp, Homo sapiens
gtgaacttgctcaggacaa

SEQ ID NO: 5586 - DNA, 19 bp, Homo sapiens
tttaggagtaacaatacaa

SEQ ID NO: 5587 - DNA, 19 bp, Homo sapiens
cctctgacagagttacttc

SEQ ID NO: 5588 - DNA, 19 bp, Homo sapiens
gccaccaccctggtgctga

SEQ ID NO: 5589 - DNA, 19 bp, Human hepatitis C virus
cagcacctgggtgctggta

SEQ ID NO: 5590 - DNA, 19 bp, Human hepatitis C virus
aactcgtccggatgcccgg

SEQ ID NO: 5591 - DNA, 19 bp, Human hepatitis C virus
cgctgctgggtagcgctca

SEQ ID NO: 5592 - DNA, 19 bp, Human hepatitis C virus
ctccggatcccacaagccg

SEQ ID NO: 5593 - DNA, 19 bp, Human hepatitis C virus
tgtaacatcgggggggtcg

SEQ ID NO: 5594 - DNA, 19 bp, Human hepatitis C virus
gtaacatcgggggggtcgg

SEQ ID NO: 5595 - DNA, 19 bp, Human hepatitis C virus
cagccaccaagcaggcgga

SEQ ID NO: 5596 - DNA, 19 bp, Human hepatitis C virus
ctcaccacccagaacaccc

SEQ ID NO: 5597 - DNA, 19 bp, Human hepatitis C virus
ccagccttaccatcaccca

SEQ ID NO: 5598 - DNA, 19 bp, Human hepatitis C virus
ctacgccgtgttccggctc

SEQ ID NO: 5599 - DNA, 19 bp, Human hepatitis C virus
tacgccgtgttccggctcg

SEQ ID NO: 5600 - DNA, 19 bp, Human hepatitis C virus
gagttcctggtaaaagcct

SEQ ID NO: 5601 - DNA, 19 bp, Human hepatitis C virus
atggcggggaactgggcta

SEQ ID NO: 5602 - DNA, 19 bp, Human hepatitis C virus
aaccaaacgtaacaccaac

SEQ ID NO: 5603 - DNA, 19 bp, Human hepatitis C virus
ggtggtcagatcgttggtg

SEQ ID NO: 5604 - DNA, 19 bp, Human hepatitis C virus
ccttggcccctctatggca

SEQ ID NO: 5605 - DNA, 19 bp, Human hepatitis C virus
taccccggccacgcgtcag

SEQ ID NO: 5606 - DNA, 19 bp, Human hepatitis C virus
gggcacgctgcccgcctca

SEQ ID NO: 5607 - DNA, 19 bp, Human hepatitis C virus
ctgcaatgactccctccag

SEQ ID NO: 5608 - DNA, 19 bp, Human hepatitis C virus
aaccgatcgtctcggcaac

SEQ ID NO: 5609 - DNA, 19 bp, Human hepatitis C virus
gtgcggggcccccccgtgt

SEQ ID NO: 5610 - DNA, 19 bp, Human hepatitis C virus
atgtggggggcgtggagca

SEQ ID NO: 5611 - DNA, 19 bp, Human hepatitis C virus
ggagagcgttgcaacttgg

SEQ ID NO: 5612 - DNA, 19 bp, Human hepatitis C virus
cgtccgttgccggagcgca

SEQ ID NO: 5613 - DNA, 19 bp, Human hepatitis C virus
gtctggcattattgacctt

SEQ ID NO: 5614 - DNA, 19 bp, Human hepatitis C virus
tctttgatatcaccaaact

SEQ ID NO: 5615 - DNA, 19 bp, Human hepatitis C virus
cttctgattgccatactcg

SEQ ID NO: 5616 - DNA, 19 bp, Human hepatitis C virus
gcggcgtgtggggacatca

SEQ ID NO: 5617 - DNA, 19 bp, Human hepatitis C virus
gggacatcatcctgggcct

SEQ ID NO: 5618 - DNA, 19 bp, Human hepatitis C virus
gggcgtcttccgggccgct

SEQ ID NO: 5619 - DNA, 19 bp, Human hepatitis C virus
ggcgtcttccgggccgctg

SEQ ID NO: 5620 - DNA, 19 bp, Human hepatitis C virus
gcgtcttccgggccgctgt

SEQ ID NO: 5621 - DNA, 19 bp, Human hepatitis C virus
gtccccggtcttcacagac

SEQ ID NO: 5622 - DNA, 19 bp, Human hepatitis C virus
catcaggactggggtaagg

SEQ ID NO: 5623 - DNA, 19 bp, Human hepatitis C virus
ccgacggtggttgctccgg

SEQ ID NO: 5624 - DNA, 19 bp, Human hepatitis C virus
ggggggaaggcacctcatt

SEQ ID NO: 5625 - DNA, 19 bp, Human hepatitis C virus
ccgagcaattcaagcagaa

SEQ ID NO: 5626 - DNA, 19 bp, Human hepatitis C virus
agatgaaggcaaaggcgtc

SEQ ID NO: 5627 - DNA, 19 bp, Human hepatitis C virus
cccctagggggcgctgcca

SEQ ID NO: 5628 - DNA, 19 bp, Human hepatitis C virus
ctcccggcctagttggggc

SEQ ID NO: 5629 - DNA, 19 bp, Human hepatitis C virus
ttccgctcgtcggcggccc

SEQ ID NO: 5630 - DNA, 19 bp, Human hepatitis C virus
cccctagggggcgctgcca

SEQ ID NO: 5631 - DNA, 19 bp, Human hepatitis C virus
gccccgccggcatgcgaca

SEQ ID NO: 5632 - DNA, 19 bp, Human hepatitis C virus
aggacgaccgggtcctttc

SEQ ID NO: 5633 - DNA, 19 bp, Human hepatitis C virus
ggacgaccgggtcctttct

SEQ ID NO: 5634 - DNA, 19 bp, Human hepatitis C virus
aaaaccaaacgtaacacca

SEQ ID NO: 5635 - DNA, 19 bp, Human hepatitis C virus
caaccgccgcccacaggac

SEQ ID NO: 5636 - DNA, 19 bp, Human hepatitis C virus
cggtggtcagatcgttggt

SEQ ID NO: 5637 - DNA, 19 bp, Human hepatitis C virus
acctgttgccgcgcagggg

SEQ ID NO: 5638 - DNA, 19 bp, Human hepatitis C virus
tgccgcgcaggggccccag

SEQ ID NO: 5639 - DNA, 19 bp, Human hepatitis C virus
gggccccaggttgggtgtg

SEQ ID NO: 5640 - DNA, 19 bp, Human hepatitis C virus
gttggggccccacggaccc

SEQ ID NO: 5641 - DNA, 19 bp, Human hepatitis C virus
ttggggccccacggacccc

SEQ ID NO: 5642 - DNA, 19 bp, Human hepatitis C virus
tggggccccacggaccccc

SEQ ID NO: 5643 - DNA, 19 bp, Human hepatitis C virus
cctcacatgcggcctcgcc

SEQ ID NO: 5644 - DNA, 19 bp, Human hepatitis C virus
cacatgcggcctcgccgac

SEQ ID NO: 5645 - DNA, 19 bp, Human hepatitis C virus
tccgctcgtcggcggcccc

SEQ ID NO: 5646 - DNA, 19 bp, Human hepatitis C virus
ggcgctgccagggccttgg

SEQ ID NO: 5647 - DNA, 19 bp, Human hepatitis C virus
ccatgtcacgaacgactgc

SEQ ID NO: 5648 - DNA, 19 bp, Human hepatitis C virus
gtgccctgcgttcgggagg

SEQ ID NO: 5649 - DNA, 19 bp, Human hepatitis C virus
tgccctgcgttcgggaggg

SEQ ID NO: 5650 - DNA, 19 bp, Human hepatitis C virus
gccctgcgttcgggagggt

SEQ ID NO: 5651 - DNA, 19 bp, Human hepatitis C virus
aggaatgctaccatcccca

SEQ ID NO: 5652 - DNA, 19 bp, Human hepatitis C virus
tccccactacgacaatacg

SEQ ID NO: 5653 - DNA, 19 bp, Human hepatitis C virus
atacgacaccacgtcgatt

SEQ ID NO: 5654 - DNA, 19 bp, Human hepatitis C virus
atttgctcgttggggcggc

SEQ ID NO: 5655 - DNA, 19 bp, Human hepatitis C virus
ccttctcgccccgccggca

SEQ ID NO: 5656 - DNA, 19 bp, Human hepatitis C virus
accccggccacgcgtcagg

SEQ ID NO: 5657 - DNA, 19 bp, Human hepatitis C virus
gccctcgtagtgtcgcagt

SEQ ID NO: 5658 - DNA, 19 bp, Human hepatitis C virus
gccgtctcagagaatccag

SEQ ID NO: 5659 - DNA, 19 bp, Human hepatitis C virus
ctgaactgcaatgactccc

SEQ ID NO: 5660 - DNA, 19 bp, Human hepatitis C virus
agactgggtttcttgccgc

SEQ ID NO: 5661 - DNA, 19 bp, Human hepatitis C virus
tcgtccggatgcccggagc

SEQ ID NO: 5662 - DNA, 19 bp, Human hepatitis C virus
ccagggatggggtcctatc

SEQ ID NO: 5663 - DNA, 19 bp, Human hepatitis C virus
gacaaccgatcgtctcggc

SEQ ID NO: 5664 - DNA, 19 bp, Human hepatitis C virus
caagacgtgcggggccccc

SEQ ID NO: 5665 - DNA, 19 bp, Human hepatitis C virus
acgtgcggggcccccccgt

SEQ ID NO: 5666 - DNA, 19 bp, Human hepatitis C virus
ccggaagcaccccgaggcc

SEQ ID NO: 5667 - DNA, 19 bp, Human hepatitis C virus
aggccacgtactcaaaatg

SEQ ID NO: 5668 - DNA, 19 bp, Human hepatitis C virus
tgtatgtggggggcgtgga

SEQ ID NO: 5669 - DNA, 19 bp, Human hepatitis C virus
gagtggcaggttctgccct

SEQ ID NO: 5670 - DNA, 19 bp, Human hepatitis C virus
tcctttgcaatcaaatggg

SEQ ID NO: 5671 - DNA, 19 bp, Human hepatitis C virus
agcccaggccgaggccgcc

SEQ ID NO: 5672 - DNA, 19 bp, Human hepatitis C virus
ggcggcatatgctttctat

SEQ ID NO: 5673 - DNA, 19 bp, Human hepatitis C virus
gcggcatatgctttctatg

SEQ ID NO: 5674 - DNA, 19 bp, Human hepatitis C virus
cggcatatgctttctatgg

SEQ ID NO: 5675 - DNA, 19 bp, Human hepatitis C virus
tgcatgtgtgggttccccc

SEQ ID NO: 5676 - DNA, 19 bp, Human hepatitis C virus
cccccctcaacgtccgggg

SEQ ID NO: 5677 - DNA, 19 bp, Human hepatitis C virus
gggcaggggtggcgactcc

SEQ ID NO: 5678 - DNA, 19 bp, Human hepatitis C virus
atgttggactgtctaccat

SEQ ID NO: 5679 - DNA, 19 bp, Human hepatitis C virus
tgttggactgtctaccatg

SEQ ID NO: 5680 - DNA, 19 bp, Human hepatitis C virus
cgttccctgacaccatgca

SEQ ID NO: 5681 - DNA, 19 bp, Human hepatitis C virus
acaccatgcacctgtggca

SEQ ID NO: 5682 - DNA, 19 bp, Human hepatitis C virus
caccatgcacctgtggcag

SEQ ID NO: 5683 - DNA, 19 bp, Human hepatitis C virus
ggcatcggcacagtcctgg

SEQ ID NO: 5684 - DNA, 19 bp, Human hepatitis C virus
aagcggagacggctggagc

SEQ ID NO: 5685 - DNA, 19 bp, Human hepatitis C virus
ggagcgcggcttgtcgtgc

SEQ ID NO: 5686 - DNA, 19 bp, Human hepatitis C virus
cgaagccatcaagggggga

SEQ ID NO: 5687 - DNA, 19 bp, Human hepatitis C virus
tggaagtgtctcatacggc

SEQ ID NO: 5688 - DNA, 19 bp, Human hepatitis C virus
gggtgctggtaggcggagt

SEQ ID NO: 5689 - DNA, 19 bp, Human hepatitis C virus
gtgggtaggatcatcttgt

SEQ ID NO: 5690 - DNA, 19 bp, Human hepatitis C virus
cgccgagcaattcaagcag

SEQ ID NO: 5691 - DNA, 19 bp, Human hepatitis C virus
tggagtccaagtggcgagc

SEQ ID NO: 5692 - DNA, 19 bp, Human hepatitis C virus
tggcgagctttggagacct

SEQ ID NO: 5693 - DNA, 19 bp, Human hepatitis C virus
gcccgctcaccacccagaa

SEQ ID NO: 5694 - DNA, 19 bp, Human hepatitis C virus
tgagtgacttcaagacctg

SEQ ID NO: 5695 - DNA, 19 bp, Human hepatitis C virus
atgtcaaaaacggttccat

SEQ ID NO: 5696 - DNA, 19 bp, Human hepatitis C virus
ccgaaaacctgcagcaaca

SEQ ID NO: 5697 - DNA, 19 bp, Human hepatitis C virus
ggcgccaaactattccaag

SEQ ID NO: 5698 - DNA, 19 bp, Human hepatitis C virus
gccctccttgagggcgaca

SEQ ID NO: 5699 - DNA, 19 bp, Human hepatitis C virus
cacccgcgtggagtcggag

SEQ ID NO: 5700 - DNA, 19 bp, Human hepatitis C virus
ggagggggatgagaatgaa

SEQ ID NO: 5701 - DNA, 19 bp, Human hepatitis C virus
gcggcgatacccatatggg

SEQ ID NO: 5702 - DNA, 19 bp, Human hepatitis C virus
ttgccacctgtcaaggccc

SEQ ID NO: 5703 - DNA, 19 bp, Human hepatitis C virus
cccccccttgagggggagc

SEQ ID NO: 5704 - DNA, 19 bp, Human hepatitis C virus
ctgctgctcaatgtcctac

SEQ ID NO: 5705 - DNA, 19 bp, Human hepatitis C virus
catggacaggtgccctgat

SEQ ID NO: 5706 - DNA, 19 bp, Human hepatitis C virus
atggacaggtgccctgatc

SEQ ID NO: 5707 - DNA, 19 bp, Human hepatitis C virus
ggctatgactaggtactcc

SEQ ID NO: 5708 - DNA, 19 bp, Human hepatitis C virus
caccatagatcactcccct

SEQ ID NO: 5709 - DNA, 19 bp, Human hepatitis C virus
agctgttcaccttctcgcc

SEQ ID NO: 5710 - DNA, 19 bp, Human hepatitis C virus
ctgcaatgactccctccag

SEQ ID NO: 5711 - DNA, 19 bp, Human hepatitis C virus
atgtggggggcgtggagca

SEQ ID NO: 5712 - DNA, 19 bp, Human hepatitis C virus
tggggacatcatcctgggc

SEQ ID NO: 5713 - DNA, 19 bp, Human hepatitis C virus
gggacatcatcctgggcct

SEQ ID NO: 5714 - DNA, 19 bp, Human hepatitis C virus
gggagatactcctggggcc

SEQ ID NO: 5715 - DNA, 19 bp, Human hepatitis C virus
atgttggactgtctaccat

SEQ ID NO: 5716 - DNA, 19 bp, Human hepatitis C virus
ccagccttaccatcaccca

SEQ ID NO: 5717 - DNA, 19 bp, Human hepatitis C virus
gccctccttgagggcgaca

SEQ ID NO: 5718 - DNA, 19 bp, Human hepatitis C virus
ccagcccccgattgggggc

SEQ ID NO: 5719 - DNA, 19 bp, Human hepatitis C virus
accatagatcactcccctg

SEQ ID NO: 5720 - DNA, 19 bp, Human hepatitis C virus
atgagtgtcgtgcagcctc

SEQ ID NO: 5721 - DNA, 19 bp, Human hepatitis C virus
gtgcagcctccaggacccc

SEQ ID NO: 5722 - DNA, 19 bp, Human hepatitis C virus
tgcagcctccaggaccccc

SEQ ID NO: 5723 - DNA, 19 bp, Human hepatitis C virus
ccaggaccccccctcccgg

SEQ ID NO: 5724 - DNA, 19 bp, Human hepatitis C virus
accccccctcccgggagag

SEQ ID NO: 5725 - DNA, 19 bp, Human hepatitis C virus
ccccctcccgggagagcca

SEQ ID NO: 5726 - DNA, 19 bp, Human hepatitis C virus
agactgctagccgagtagt

SEQ ID NO: 5727 - DNA, 19 bp, Human hepatitis C virus
agccgagtagtgttgggtc

SEQ ID NO: 5728 - DNA, 19 bp, Human hepatitis C virus
ggtgcttgcgagtgccccg

SEQ ID NO: 5729 - DNA, 19 bp, Human hepatitis C virus
gcgagtgccccgggaggtc

SEQ ID NO: 5730 - DNA, 19 bp, Human hepatitis C virus
accgtgcaccatgagcacg

SEQ ID NO: 5731 - DNA, 19 bp, Human hepatitis C virus
cccgggcggtggtcagatc

SEQ ID NO: 5732 - DNA, 19 bp, Human hepatitis C virus
gccgcgcaggggccccagg

SEQ ID NO: 5733 - DNA, 19 bp, Human hepatitis C virus
accccgtggaaggcgacag

SEQ ID NO: 5734 - DNA, 19 bp, Human hepatitis C virus
ccccgtggaaggcgacagc

SEQ ID NO: 5735 - DNA, 19 bp, Human hepatitis C virus
agcctatccccaaggctcg

SEQ ID NO: 5736 - DNA, 19 bp, Human hepatitis C virus
ctatccccaaggctcgccg

SEQ ID NO: 5737 - DNA, 19 bp, Human hepatitis C virus
tatccccaaggctcgccgg

SEQ ID NO: 5738 - DNA, 19 bp, Human hepatitis C virus
cgggtatccttggcccctc

SEQ ID NO: 5739 - DNA, 19 bp, Human hepatitis C virus
gcatggggtgggcaggatg

SEQ ID NO: 5740 - DNA, 19 bp, Human hepatitis C virus
tcctgtcaccccgcggctc

SEQ ID NO: 5741 - DNA, 19 bp, Human hepatitis C virus
gggccccacggacccccgg

SEQ ID NO: 5742 - DNA, 19 bp, Human hepatitis C virus
ggccccacggacccccggc

SEQ ID NO: 5743 - DNA, 19 bp, Human hepatitis C virus
cggcctcgccgacctcatg

SEQ ID NO: 5744 - DNA, 19 bp, Human hepatitis C virus
ggcctcgccgacctcatgg

SEQ ID NO: 5745 - DNA, 19 bp, Human hepatitis C virus
ggccccctagggggcgctg

SEQ ID NO: 5746 - DNA, 19 bp, Human hepatitis C virus
tggcacatggtgtccgggt

SEQ ID NO: 5747 - DNA, 19 bp, Human hepatitis C virus
cttcctcttggctctgctg

SEQ ID NO: 5748 - DNA, 19 bp, Human hepatitis C virus
catgtcacgaacgactgct

SEQ ID NO: 5749 - DNA, 19 bp, Human hepatitis C virus
gaggcggcggacttgatca

SEQ ID NO: 5750 - DNA, 19 bp, Human hepatitis C virus
catccccactacgacaata

SEQ ID NO: 5751 - DNA, 19 bp, Human hepatitis C virus
gctgttcaccttctcgccc

SEQ ID NO: 5752 - DNA, 19 bp, Human hepatitis C virus
gccccgccggcatgcgaca

SEQ ID NO: 5753 - DNA, 19 bp, Human hepatitis C virus
tggcctgggacatgatgat

SEQ ID NO: 5754 - DNA, 19 bp, Human hepatitis C virus
cacaagccgtcatcgacat

SEQ ID NO: 5755 - DNA, 19 bp, Human hepatitis C virus
agccgtcatcgacatggtg

SEQ ID NO: 5756 - DNA, 19 bp, Human hepatitis C virus
ggtggcgggggcccactgg

SEQ ID NO: 5757 - DNA, 19 bp, Human hepatitis C virus
gggggcccactggggagtc

SEQ ID NO: 5758 - DNA, 19 bp, Human hepatitis C virus
atggcggggaactgggcta

SEQ ID NO: 5759 - DNA, 19 bp, Human hepatitis C virus
ttgattgtgatgctacttt

SEQ ID NO: 5760 - DNA, 19 bp, Human hepatitis C virus
caacgggggggcacgctgc

SEQ ID NO: 5761 - DNA, 19 bp, Human hepatitis C virus
acgctgcccgcctcaccag

SEQ ID NO: 5762 - DNA, 19 bp, Human hepatitis C virus
tcagagaatccagcttata

SEQ ID NO: 5763 - DNA, 19 bp, Human hepatitis C virus
accaatggcagttggcaca

SEQ ID NO: 5764 - DNA, 19 bp, Human hepatitis C virus
ccaatggcagttggcacat

SEQ ID NO: 5765 - DNA, 19 bp, Human hepatitis C virus
gtcctatcacttatgctga

SEQ ID NO: 5766 - DNA, 19 bp, Human hepatitis C virus
ctgagcctacaaaagaccc

SEQ ID NO: 5767 - DNA, 19 bp, Human hepatitis C virus
caggtgtgtggtccagtgt

SEQ ID NO: 5768 - DNA, 19 bp, Human hepatitis C virus
tgtggtccagtgtattgct

SEQ ID NO: 5769 - DNA, 19 bp, Human hepatitis C virus
gcttcaccccaagtcctgt

SEQ ID NO: 5770 - DNA, 19 bp, Human hepatitis C virus
ctgttgtcgtggggacaac

SEQ ID NO: 5771 - DNA, 19 bp, Human hepatitis C virus
gccgccgcaaggcaactgg

SEQ ID NO: 5772 - DNA, 19 bp, Human hepatitis C virus
ggcaactggttcggctgta

SEQ ID NO: 5773 - DNA, 19 bp, Human hepatitis C virus
gcaactggttcggctgtac

SEQ ID NO: 5774 - DNA, 19 bp, Human hepatitis C virus
ccccgtgtaacatcggggg

SEQ ID NO: 5775 - DNA, 19 bp, Human hepatitis C virus
ggactgcttccggaagcac

SEQ ID NO: 5776 - DNA, 19 bp, Human hepatitis C virus
gactgcttccggaagcacc

SEQ ID NO: 5777 - DNA, 19 bp, Human hepatitis C virus
tccggaagcaccccgaggc

SEQ ID NO: 5778 - DNA, 19 bp, Human hepatitis C virus
actcaaaatgtggctcggg

SEQ ID NO: 5779 - DNA, 19 bp, Human hepatitis C virus
ggccttggttgacacctag

SEQ ID NO: 5780 - DNA, 19 bp, Human hepatitis C virus
aggagagcgttgcaacttg

SEQ ID NO: 5781 - DNA, 19 bp, Human hepatitis C virus
ggacagatcggagctcagc

SEQ ID NO: 5782 - DNA, 19 bp, Human hepatitis C virus
cagatcggagctcagcccg

SEQ ID NO: 5783 - DNA, 19 bp, Human hepatitis C virus
ggagctcagcccgctgctg

SEQ ID NO: 5784 - DNA, 19 bp, Human hepatitis C virus
caccctaccggctctgtcc

SEQ ID NO: 5785 - DNA, 19 bp, Human hepatitis C virus
cggctctgtccactggctt

SEQ ID NO: 5786 - DNA, 19 bp, Human hepatitis C virus
ccatcagaacatcgtggac

SEQ ID NO: 5787 - DNA, 19 bp, Human hepatitis C virus
ggtcagcggttgtctcctt

SEQ ID NO: 5788 - DNA, 19 bp, Human hepatitis C virus
gccgccttagagaacctgg

SEQ ID NO: 5789 - DNA, 19 bp, Human hepatitis C virus
gccttagagaacctggtgg

SEQ ID NO: 5790 - DNA, 19 bp, Human hepatitis C virus
gccggagcgcacggcatcc

SEQ ID NO: 5791 - DNA, 19 bp, Human hepatitis C virus
gctgcatcgtgcggaggcg

SEQ ID NO: 5792 - DNA, 19 bp, Human hepatitis C virus
attattgaccttgtcgcca

SEQ ID NO: 5793 - DNA, 19 bp, Human hepatitis C virus
tcgccatattacaaggtgt

SEQ ID NO: 5794 - DNA, 19 bp, Human hepatitis C virus
cgccatattacaaggtgtt

SEQ ID NO: 5795 - DNA, 19 bp, Human hepatitis C virus
gtccggggaggccgcgatg

SEQ ID NO: 5796 - DNA, 19 bp, Human hepatitis C virus
tcaccccactgcgggattg

SEQ ID NO: 5797 - DNA, 19 bp, Human hepatitis C virus
ttgggcccacgccggccta

SEQ ID NO: 5798 - DNA, 19 bp, Human hepatitis C virus
ctacgggaccttgcggtag

SEQ ID NO: 5799 - DNA, 19 bp, Human hepatitis C virus
cctgtcgtcttctctgaca

SEQ ID NO: 5800 - DNA, 19 bp, Human hepatitis C virus
ctgtcgtcttctctgacat

SEQ ID NO: 5801 - DNA, 19 bp, Human hepatitis C virus
cctggggggcagacaccgc

SEQ ID NO: 5802 - DNA, 19 bp, Human hepatitis C virus
gggggcagacaccgcggcg

SEQ ID NO: 5803 - DNA, 19 bp, Human hepatitis C virus
ggcgtgtggggacatcatc

SEQ ID NO: 5804 - DNA, 19 bp, Human hepatitis C virus
tggggccggccgatagtct

SEQ ID NO: 5805 - DNA, 19 bp, Human hepatitis C virus
gaaccaggtcgagggggag

SEQ ID NO: 5806 - DNA, 19 bp, Human hepatitis C virus
gagggggaggttcaagtgg

SEQ ID NO: 5807 - DNA, 19 bp, Human hepatitis C virus
aggcccaatcgcccagatg

SEQ ID NO: 5808 - DNA, 19 bp, Human hepatitis C virus
ggcccaatcgcccagatgt

SEQ ID NO: 5809 - DNA, 19 bp, Human hepatitis C virus
caggatctcgtcggctggc

SEQ ID NO: 5810 - DNA, 19 bp, Human hepatitis C virus
aggatctcgtcggctggcc

SEQ ID NO: 5811 - DNA, 19 bp, Human hepatitis C virus
gccccccggggcgcgttcc

SEQ ID NO: 5812 - DNA, 19 bp, Human hepatitis C virus
gcacctgtggcagctcgga

SEQ ID NO: 5813 - DNA, 19 bp, Human hepatitis C virus
ctgtggcagctcggacctt

SEQ ID NO: 5814 - DNA, 19 bp, Human hepatitis C virus
gcggggcgacaatagaggg

SEQ ID NO: 5815 - DNA, 19 bp, Human hepatitis C virus
ggagcttgctctcccccag

SEQ ID NO: 5816 - DNA, 19 bp, Human hepatitis C virus
gagcttgctctcccccagg

SEQ ID NO: 5817 - DNA, 19 bp, Human hepatitis C virus
acttgaagggctcttcggg

SEQ ID NO: 5818 - DNA, 19 bp, Human hepatitis C virus
tgtccccgttgagtccatg

SEQ ID NO: 5819 - DNA, 19 bp, Human hepatitis C virus
gaaactactatgcggtccc

SEQ ID NO: 5820 - DNA, 19 bp, Human hepatitis C virus
aaactactatgcggtcccc

SEQ ID NO: 5821 - DNA, 19 bp, Human hepatitis C virus
ctcccactggcagcggcaa

SEQ ID NO: 5822 - DNA, 19 bp, Human hepatitis C virus
ggcgtatatgtctaaagca

SEQ ID NO: 5823 - DNA, 19 bp, Human hepatitis C virus
gcgtatatgtctaaagcac

SEQ ID NO: 5824 - DNA, 19 bp, Human hepatitis C virus
tggggtaaggaccattacc

SEQ ID NO: 5825 - DNA, 19 bp, Human hepatitis C virus
accattaccacgggcgccc

SEQ ID NO: 5826 - DNA, 19 bp, Human hepatitis C virus
cgtactccacctatggcaa

SEQ ID NO: 5827 - DNA, 19 bp, Human hepatitis C virus
cagtcctggaccaagcgga

SEQ ID NO: 5828 - DNA, 19 bp, Human hepatitis C virus
aggggggaaggcacctcat

SEQ ID NO: 5829 - DNA, 19 bp, Human hepatitis C virus
cactccaagaagaagtgcg

SEQ ID NO: 5830 - DNA, 19 bp, Human hepatitis C virus
atcaatgctgtagcgtatt

SEQ ID NO: 5831 - DNA, 19 bp, Human hepatitis C virus
cataccgaccagcggagac

SEQ ID NO: 5832 - DNA, 19 bp, Human hepatitis C virus
aggactggcaggggcaggg

SEQ ID NO: 5833 - DNA, 19 bp, Human hepatitis C virus
gggaacggccctcgggcat

SEQ ID NO: 5834 - DNA, 19 bp, Human hepatitis C virus
cgggcatgttcgattcctc

SEQ ID NO: 5835 - DNA, 19 bp, Human hepatitis C virus
tggtacgagctcacccccg

SEQ ID NO: 5836 - DNA, 19 bp, Human hepatitis C virus
gggcttacctaaatacacc

SEQ ID NO: 5837 - DNA, 19 bp, Human hepatitis C virus
ggcttacctaaatacacca

SEQ ID NO: 5838 - DNA, 19 bp, Human hepatitis C virus
gagataacttcccctacct

SEQ ID NO: 5839 - DNA, 19 bp, Human hepatitis C virus
cccacctccatcgtgggat

SEQ ID NO: 5840 - DNA, 19 bp, Human hepatitis C virus
catggcatgcatgtcggcc

SEQ ID NO: 5841 - DNA, 19 bp, Human hepatitis C virus
ggccgacctggaagtcgtc

SEQ ID NO: 5842 - DNA, 19 bp, Human hepatitis C virus
gccgacctggaagtcgtca

SEQ ID NO: 5843 - DNA, 19 bp, Human hepatitis C virus
tggaagtcgtcaccagcac

SEQ ID NO: 5844 - DNA, 19 bp, Human hepatitis C virus
gcacctgggtgctggtagg

SEQ ID NO: 5845 - DNA, 19 bp, Human hepatitis C virus
ggttatcgtgggtaggatc

SEQ ID NO: 5846 - DNA, 19 bp, Human hepatitis C virus
cccgatagggaagtcctct

SEQ ID NO: 5847 - DNA, 19 bp, Human hepatitis C virus
tgaaatggaagaatgcgcc

SEQ ID NO: 5848 - DNA, 19 bp, Human hepatitis C virus
ccaagtggcgagctttgga

SEQ ID NO: 5849 - DNA, 19 bp, Human hepatitis C virus
ttcatcagcgggatacagt

SEQ ID NO: 5850 - DNA, 19 bp, Human hepatitis C virus
agcgggcttatccaccctg

SEQ ID NO: 5851 - DNA, 19 bp, Human hepatitis C virus
ccagcccgctcaccaccca

SEQ ID NO: 5852 - DNA, 19 bp, Human hepatitis C virus
gtgggcgctggtatcgctg

SEQ ID NO: 5853 - DNA, 19 bp, Human hepatitis C virus
ggaaggtgctagtggacat

SEQ ID NO: 5854 - DNA, 19 bp, Human hepatitis C virus
ggtcatgagcggcgaggcg

SEQ ID NO: 5855 - DNA, 19 bp, Human hepatitis C virus
catgtgggcccgggagagg

SEQ ID NO: 5856 - DNA, 19 bp, Human hepatitis C virus
atgtgggcccgggagaggg

SEQ ID NO: 5857 - DNA, 19 bp, Human hepatitis C virus
ggggccgtgcagtggatga

SEQ ID NO: 5858 - DNA, 19 bp, Human hepatitis C virus
gcgttcgcttcgcggggta

SEQ ID NO: 5859 - DNA, 19 bp, Human hepatitis C virus
ggggtaaccatgtctcccc

SEQ ID NO: 5860 - DNA, 19 bp, Human hepatitis C virus
catcacccagctgctgaag

SEQ ID NO: 5861 - DNA, 19 bp, Human hepatitis C virus
aggactgttctacgccgtg

SEQ ID NO: 5862 - DNA, 19 bp, Human hepatitis C virus
ttcaagacctggctccagt

SEQ ID NO: 5863 - DNA, 19 bp, Human hepatitis C virus
ctcctgccgcggttaccgg

SEQ ID NO: 5864 - DNA, 19 bp, Human hepatitis C virus
caccacgggcccctgcacg

SEQ ID NO: 5865 - DNA, 19 bp, Human hepatitis C virus
ggaggtcacgcgggtgggg

SEQ ID NO: 5866 - DNA, 19 bp, Human hepatitis C virus
gaggtcacgcgggtggggg

SEQ ID NO: 5867 - DNA, 19 bp, Human hepatitis C virus
atgtcaggttccagctcct

SEQ ID NO: 5868 - DNA, 19 bp, Human hepatitis C virus
atgaaatatccattgcggc

SEQ ID NO: 5869 - DNA, 19 bp, Human hepatitis C virus
ctccattgttagagtcttg

SEQ ID NO: 5870 - DNA, 19 bp, Human hepatitis C virus
tgcccattgccacctgtca

SEQ ID NO: 5871 - DNA, 19 bp, Human hepatitis C virus
accacctccacggagaaaa

SEQ ID NO: 5872 - DNA, 19 bp, Human hepatitis C virus
ccacctccacggagaaaaa

SEQ ID NO: 5873 - DNA, 19 bp, Human hepatitis C virus
acctccacggagaaaaagg

SEQ ID NO: 5874 - DNA, 19 bp, Human hepatitis C virus
ggttgtcctgacggactcc

SEQ ID NO: 5875 - DNA, 19 bp, Human hepatitis C virus
cctgaccagacctccgaca

SEQ ID NO: 5876 - DNA, 19 bp, Human hepatitis C virus
agcaagctgcccatcaacg

SEQ ID NO: 5877 - DNA, 19 bp, Human hepatitis C virus
ggatgaccattaccgggac

SEQ ID NO: 5878 - DNA, 19 bp, Human hepatitis C virus
tggcaaagaatgaggtttt

SEQ ID NO: 5879 - DNA, 19 bp, Human hepatitis C virus
ggcaaagaatgaggttttc

SEQ ID NO: 5880 - DNA, 19 bp, Human hepatitis C virus
gggcagcgggtcgagttcc

SEQ ID NO: 5881 - DNA, 19 bp, Human hepatitis C virus
gactagctgcggtaatacc

SEQ ID NO: 5882 - DNA, 19 bp, Human hepatitis C virus
ctcgcgatcccaccacccc

SEQ ID NO: 5883 - DNA, 19 bp, Human hepatitis C virus
aggatgattctgatgaccc

SEQ ID NO: 5884 - DNA, 19 bp, Human hepatitis C virus
agccacttgacctacctca

SEQ ID NO: 5885 - DNA, 19 bp, Human hepatitis C virus
gggtaccgcccttgcgagt

SEQ ID NO: 5886 - DNA, 19 bp, Human hepatitis C virus
ctgcaatgactccctccag

SEQ ID NO: 5887 - DNA, 19 bp, Human hepatitis C virus
ccagcccccgattgggggc

SEQ ID NO: 5888 - DNA, 19 bp, Human hepatitis C virus
aaggcgacagcctatcccc

SEQ ID NO: 5889 - DNA, 19 bp, Human hepatitis C virus
ggccccacggacccccggc

SEQ ID NO: 5890 - DNA, 19 bp, Human hepatitis C virus
gaggcggcggacttgatca

SEQ ID NO: 5891 - DNA, 19 bp, Human hepatitis C virus
ctgcaattgttcgatctac

SEQ ID NO: 5892 - DNA, 19 bp, Human hepatitis C virus
ctccagactgggtttcttg

SEQ ID NO: 5893 - DNA, 19 bp, Human hepatitis C virus
tcgtacctgcgtcgcaggt

SEQ ID NO: 5894 - DNA, 19 bp, Human hepatitis C virus
caagacgtgcggggccccc

SEQ ID NO: 5895 - DNA, 19 bp, Human hepatitis C virus
aatgctgcatgcaactgga

SEQ ID NO: 5896 - DNA, 19 bp, Human hepatitis C virus
caccctaccggctctgtcc

SEQ ID NO: 5897 - DNA, 19 bp, Human hepatitis C virus
cgccatattacaaggtgtt

SEQ ID NO: 5898 - DNA, 19 bp, Human hepatitis C virus
cgaagccatcaagggggga

SEQ ID NO: 5899 - DNA, 19 bp, Human hepatitis C virus
ccagcccgctcaccaccca

SEQ ID NO: 5900 - DNA, 19 bp, Human hepatitis C virus
ggctatgactaggtactcc

SEQ ID NO: 5901 - DNA, 19 bp, Human hepatitis C virus
ctccaccatagatcactcc

SEQ ID NO: 5902 - DNA, 19 bp, Human hepatitis C virus
tccaccatagatcactccc

SEQ ID NO: 5903 - DNA, 19 bp, Human hepatitis C virus
caccatagatcactcccct

SEQ ID NO: 5904 - DNA, 19 bp, Human hepatitis C virus
tcactcccctgtgaggaac

SEQ ID NO: 5905 - DNA, 19 bp, Human hepatitis C virus
cgttagtatgagtgtcgtg

SEQ ID NO: 5906 - DNA, 19 bp, Human hepatitis C virus
tgtcgtgcagcctccagga

SEQ ID NO: 5907 - DNA, 19 bp, Human hepatitis C virus
ccccccctcccgggagagc

SEQ ID NO: 5908 - DNA, 19 bp, Human hepatitis C virus
ggagagccatagtggtctg

SEQ ID NO: 5909 - DNA, 19 bp, Human hepatitis C virus
gagccatagtggtctgcgg

SEQ ID NO: 5910 - DNA, 19 bp, Human hepatitis C virus
gtggtctgcggaaccggtg

SEQ ID NO: 5911 - DNA, 19 bp, Human hepatitis C virus
agtacaccggaattgccag

SEQ ID NO: 5912 - DNA, 19 bp, Human hepatitis C virus
ggtcctttcttggatcaac

SEQ ID NO: 5913 - DNA, 19 bp, Human hepatitis C virus
ttcttggatcaacccgctc

SEQ ID NO: 5914 - DNA, 19 bp, Human hepatitis C virus
ctcaatgcctggagatttg

SEQ ID NO: 5915 - DNA, 19 bp, Human hepatitis C virus
tgcctggagatttgggcgt

SEQ ID NO: 5916 - DNA, 19 bp, Human hepatitis C virus
gcctggagatttgggcgtg

SEQ ID NO: 5917 - DNA, 19 bp, Human hepatitis C virus
gagatttgggcgtgccccc

SEQ ID NO: 5918 - DNA, 19 bp, Human hepatitis C virus
aaaggccttgtggtactgc

SEQ ID NO: 5919 - DNA, 19 bp, Human hepatitis C virus
aaggccttgtggtactgcc

SEQ ID NO: 5920 - DNA, 19 bp, Human hepatitis C virus
gtggtactgcctgataggg

SEQ ID NO: 5921 - DNA, 19 bp, Human hepatitis C virus
cctgatagggtgcttgcga

SEQ ID NO: 5922 - DNA, 19 bp, Human hepatitis C virus
cgagtgccccgggaggtct

SEQ ID NO: 5923 - DNA, 19 bp, Human hepatitis C virus
gccccgggaggtctcgtag

SEQ ID NO: 5924 - DNA, 19 bp, Human hepatitis C virus
ttacctgttgccgcgcagg

SEQ ID NO: 5925 - DNA, 19 bp, Human hepatitis C virus
tacctgttgccgcgcaggg

SEQ ID NO: 5926 - DNA, 19 bp, Human hepatitis C virus
cctgttgccgcgcaggggc

SEQ ID NO: 5927 - DNA, 19 bp, Human hepatitis C virus
ctgttgccgcgcaggggcc

SEQ ID NO: 5928 - DNA, 19 bp, Human hepatitis C virus
tccgagcggtcgcaacccc

SEQ ID NO: 5929 - DNA, 19 bp, Human hepatitis C virus
ggtcgcaaccccgtggaag

SEQ ID NO: 5930 - DNA, 19 bp, Human hepatitis C virus
gtcgcaaccccgtggaagg

SEQ ID NO: 5931 - DNA, 19 bp, Human hepatitis C virus
aaggcgacagcctatcccc

SEQ ID NO: 5932 - DNA, 19 bp, Human hepatitis C virus
cagcctatccccaaggctc

SEQ ID NO: 5933 - DNA, 19 bp, Human hepatitis C virus
gagggcagggcctgggctc

SEQ ID NO: 5934 - DNA, 19 bp, Human hepatitis C virus
cagggcctgggctcagccc

SEQ ID NO: 5935 - DNA, 19 bp, Human hepatitis C virus
gggcctgggctcagcccgg

SEQ ID NO: 5936 - DNA, 19 bp, Human hepatitis C virus
cctgggctcagcccgggta

SEQ ID NO: 5937 - DNA, 19 bp, Human hepatitis C virus
cccctctatggcaatgagg

SEQ ID NO: 5938 - DNA, 19 bp, Human hepatitis C virus
gagggcatggggtgggcag

SEQ ID NO: 5939 - DNA, 19 bp, Human hepatitis C virus
agggcatggggtgggcagg

SEQ ID NO: 5940 - DNA, 19 bp, Human hepatitis C virus
aggatggctcctgtcaccc

SEQ ID NO: 5941 - DNA, 19 bp, Human hepatitis C virus
gatggctcctgtcaccccg

SEQ ID NO: 5942 - DNA, 19 bp, Human hepatitis C virus
tgtcaccccgcggctcccg

SEQ ID NO: 5943 - DNA, 19 bp, Human hepatitis C virus
gtcaccccgcggctcccgg

SEQ ID NO: 5944 - DNA, 19 bp, Human hepatitis C virus
gcggctcccggcctagttg

SEQ ID NO: 5945 - DNA, 19 bp, Human hepatitis C virus
ctcccggcctagttggggc

SEQ ID NO: 5946 - DNA, 19 bp, Human hepatitis C virus
ataccctcacatgcggcct

SEQ ID NO: 5947 - DNA, 19 bp, Human hepatitis C virus
ttccgctcgtcggcggccc

SEQ ID NO: 5948 - DNA, 19 bp, Human hepatitis C virus
cccctagggggcgctgcca

SEQ ID NO: 5949 - DNA, 19 bp, Human hepatitis C virus
tgcaacagggaacctgccc

SEQ ID NO: 5950 - DNA, 19 bp, Human hepatitis C virus
gcgtaacgcgtccggggta

SEQ ID NO: 5951 - DNA, 19 bp, Human hepatitis C virus
tcaagcattgtgtttgagg

SEQ ID NO: 5952 - DNA, 19 bp, Human hepatitis C virus
cccacgctcgcggccagga

SEQ ID NO: 5953 - DNA, 19 bp, Human hepatitis C virus
cggccaggaatgctaccat

SEQ ID NO: 5954 - DNA, 19 bp, Human hepatitis C virus
acgacaatacgacaccacg

SEQ ID NO: 5955 - DNA, 19 bp, Human hepatitis C virus
gggcggctgctctctgctc

SEQ ID NO: 5956 - DNA, 19 bp, Human hepatitis C virus
cgtgggggacctctgcgga

SEQ ID NO: 5957 - DNA, 19 bp, Human hepatitis C virus
agctgttcaccttctcgcc

SEQ ID NO: 5958 - DNA, 19 bp, Human hepatitis C virus
ctgttcaccttctcgcccc

SEQ ID NO: 5959 - DNA, 19 bp, Human hepatitis C virus
ctgcaattgttcgatctac

SEQ ID NO: 5960 - DNA, 19 bp, Human hepatitis C virus
attgttcgatctaccccgg

SEQ ID NO: 5961 - DNA, 19 bp, Human hepatitis C virus
atctaccccggccacgcgt

SEQ ID NO: 5962 - DNA, 19 bp, Human hepatitis C virus
cggccacgcgtcaggtcac

SEQ ID NO: 5963 - DNA, 19 bp, Human hepatitis C virus
ccgcatggcctgggacatg

SEQ ID NO: 5964 - DNA, 19 bp, Human hepatitis C virus
cgcagttactccggatccc

SEQ ID NO: 5965 - DNA, 19 bp, Human hepatitis C virus
cccacaagccgtcatcgac

SEQ ID NO: 5966 - DNA, 19 bp, Human hepatitis C virus
ctggggagtcctggcgggc

SEQ ID NO: 5967 - DNA, 19 bp, Human hepatitis C virus
ggcgggccttgcctactat

SEQ ID NO: 5968 - DNA, 19 bp, Human hepatitis C virus
tttgccggcgttgacgggc

SEQ ID NO: 5969 - DNA, 19 bp, Human hepatitis C virus
caccctcacaacggggggg

SEQ ID NO: 5970 - DNA, 19 bp, Human hepatitis C virus
gggggggcacgctgcccgc

SEQ ID NO: 5971 - DNA, 19 bp, Human hepatitis C virus
ggggcacgctgcccgcctc

SEQ ID NO: 5972 - DNA, 19 bp, Human hepatitis C virus
gcccgcctcaccagcgggt

SEQ ID NO: 5973 - DNA, 19 bp, Human hepatitis C virus
atccagcttataaacacca

SEQ ID NO: 5974 - DNA, 19 bp, Human hepatitis C virus
ctccagactgggtttcttg

SEQ ID NO: 5975 - DNA, 19 bp, Human hepatitis C virus
cccggagcgcatggccagc

SEQ ID NO: 5976 - DNA, 19 bp, Human hepatitis C virus
ctgccgctccattgacaag

SEQ ID NO: 5977 - DNA, 19 bp, Human hepatitis C virus
aagttcgaccagggatggg

SEQ ID NO: 5978 - DNA, 19 bp, Human hepatitis C virus
ggggtcctatcacttatgc

SEQ ID NO: 5979 - DNA, 19 bp, Human hepatitis C virus
ccagaggccttattgctgg

SEQ ID NO: 5980 - DNA, 19 bp, Human hepatitis C virus
cccacctcaacaatgtggt

SEQ ID NO: 5981 - DNA, 19 bp, Human hepatitis C virus
tcgtacctgcgtcgcaggt

SEQ ID NO: 5982 - DNA, 19 bp, Human hepatitis C virus
tgcgtcgcaggtgtgtggt

SEQ ID NO: 5983 - DNA, 19 bp, Human hepatitis C virus
tggggacaaccgatcgtct

SEQ ID NO: 5984 - DNA, 19 bp, Human hepatitis C virus
cagctggggggagaacgat

SEQ ID NO: 5985 - DNA, 19 bp, Human hepatitis C virus
cgccgcaaggcaactggtt

SEQ ID NO: 5986 - DNA, 19 bp, Human hepatitis C virus
gccgcaaggcaactggttc

SEQ ID NO: 5987 - DNA, 19 bp, Human hepatitis C virus
ctgtacatggatgaatagc

SEQ ID NO: 5988 - DNA, 19 bp, Human hepatitis C virus
tgtacatggatgaatagca

SEQ ID NO: 5989 - DNA, 19 bp, Human hepatitis C virus
gttcaccaagacgtgcggg

SEQ ID NO: 5990 - DNA, 19 bp, Human hepatitis C virus
agacgtgcggggccccccc

SEQ ID NO: 5991 - DNA, 19 bp, Human hepatitis C virus
cccccgtgtaacatcgggg

SEQ ID NO: 5992 - DNA, 19 bp, Human hepatitis C virus
taacaccttgacctgcccc

SEQ ID NO: 5993 - DNA, 19 bp, Human hepatitis C virus
ggctctggcactacccctg

SEQ ID NO: 5994 - DNA, 19 bp, Human hepatitis C virus
tgcactgtcaacttctcca

SEQ ID NO: 5995 - DNA, 19 bp, Human hepatitis C virus
caggcttaatgctgcatgc

SEQ ID NO: 5996 - DNA, 19 bp, Human hepatitis C virus
aatgctgcatgcaactgga

SEQ ID NO: 5997 - DNA, 19 bp, Human hepatitis C virus
ctgcatgcaactggacccg

SEQ ID NO: 5998 - DNA, 19 bp, Human hepatitis C virus
caactggacccgaggagag

SEQ ID NO: 5999 - DNA, 19 bp, Human hepatitis C virus
gacagggacagatcggagc

SEQ ID NO: 6000 - DNA, 19 bp, Human hepatitis C virus
gacagatcggagctcagcc

SEQ ID NO: 6001 - DNA, 19 bp, Human hepatitis C virus
acagatcggagctcagccc

SEQ ID NO: 6002 - DNA, 19 bp, Human hepatitis C virus
actggcttgatccacctcc

SEQ ID NO: 6003 - DNA, 19 bp, Human hepatitis C virus
ggcttgatccacctccatc

SEQ ID NO: 6004 - DNA, 19 bp, Human hepatitis C virus
gtcagcggttgtctccttt

SEQ ID NO: 6005 - DNA, 19 bp, Human hepatitis C virus
gagtatgtcgtgttgcttt

SEQ ID NO: 6006 - DNA, 19 bp, Human hepatitis C virus
tgtggatgatgctgctgat

SEQ ID NO: 6007 - DNA, 19 bp, Human hepatitis C virus
ccgaggccgccttagagaa

SEQ ID NO: 6008 - DNA, 19 bp, Human hepatitis C virus
agaacctggtggccctcaa

SEQ ID NO: 6009 - DNA, 19 bp, Human hepatitis C virus
tacatcaagggcaggctgg

SEQ ID NO: 6010 - DNA, 19 bp, Human hepatitis C virus
caagggcaggctggtccct

SEQ ID NO: 6011 - DNA, 19 bp, Human hepatitis C virus
gcatggccgctgctcctgc

SEQ ID NO: 6012 - DNA, 19 bp, Human hepatitis C virus
catggccgctgctcctgct

SEQ ID NO: 6013 - DNA, 19 bp, Human hepatitis C virus
gccgctgctcctgctcctc

SEQ ID NO: 6014 - DNA, 19 bp, Human hepatitis C virus
ggagatggctgcatcgtgc

SEQ ID NO: 6015 - DNA, 19 bp, Human hepatitis C virus
atggctgcatcgtgcggag

SEQ ID NO: 6016 - DNA, 19 bp, Human hepatitis C virus
ggcgcggtttttgtgggtc

SEQ ID NO: 6017 - DNA, 19 bp, Human hepatitis C virus
tcttatcaccagagctgag

SEQ ID NO: 6018 - DNA, 19 bp, Human hepatitis C virus
gtgtgggttccccccctca

SEQ ID NO: 6019 - DNA, 19 bp, Human hepatitis C virus
tccccccctcaacgtccgg

SEQ ID NO: 6020 - DNA, 19 bp, Human hepatitis C virus
ctcaacgtccggggaggcc

SEQ ID NO: 6021 - DNA, 19 bp, Human hepatitis C virus
accaaacttctgattgcca

SEQ ID NO: 6022 - DNA, 19 bp, Human hepatitis C virus
caaacttctgattgccata

SEQ ID NO: 6023 - DNA, 19 bp, Human hepatitis C virus
ggaccgctcatggtgctcc

SEQ ID NO: 6024 - DNA, 19 bp, Human hepatitis C virus
gaccgctcatggtgctcca

SEQ ID NO: 6025 - DNA, 19 bp, Human hepatitis C virus
atgcatgttagtgcggaaa

SEQ ID NO: 6026 - DNA, 19 bp, Human hepatitis C virus
ttatgtccaaatggccttc

SEQ ID NO: 6027 - DNA, 19 bp, Human hepatitis C virus
ccaaatggccttcatgaga

SEQ ID NO: 6028 - DNA, 19 bp, Human hepatitis C virus
ccttcatgagactgggcgc

SEQ ID NO: 6029 - DNA, 19 bp, Human hepatitis C virus
ccttgcggtagcagtggag

SEQ ID NO: 6030 - DNA, 19 bp, Human hepatitis C virus
tgtcgtcttctctgacatg

SEQ ID NO: 6031 - DNA, 19 bp, Human hepatitis C virus
tggggggcagacaccgcgg

SEQ ID NO: 6032 - DNA, 19 bp, Human hepatitis C virus
ggggggcagacaccgcggc

SEQ ID NO: 6033 - DNA, 19 bp, Human hepatitis C virus
gtggggacatcatcctggg

SEQ ID NO: 6034 - DNA, 19 bp, Human hepatitis C virus
tggggacatcatcctgggc

SEQ ID NO: 6035 - DNA, 19 bp, Human hepatitis C virus
ggggacatcatcctgggcc

SEQ ID NO: 6036 - DNA, 19 bp, Human hepatitis C virus
acctgtctccgcccgaagg

SEQ ID NO: 6037 - DNA, 19 bp, Human hepatitis C virus
tgtctccgcccgaagggga

SEQ ID NO: 6038 - DNA, 19 bp, Human hepatitis C virus
gggagatactcctggggcc

SEQ ID NO: 6039 - DNA, 19 bp, Human hepatitis C virus
ctcccaacagacccggggc

SEQ ID NO: 6040 - DNA, 19 bp, Human hepatitis C virus
tccaccgcaacacaatctt

SEQ ID NO: 6041 - DNA, 19 bp, Human hepatitis C virus
cacaatctttcctggcgac

SEQ ID NO: 6042 - DNA, 19 bp, Human hepatitis C virus
ggctggccggcgccccccg

SEQ ID NO: 6043 - DNA, 19 bp, Human hepatitis C virus
ccccggggcgcgttccctg

SEQ ID NO: 6044 - DNA, 19 bp, Human hepatitis C virus
tccctgacaccatgcacct

SEQ ID NO: 6045 - DNA, 19 bp, Human hepatitis C virus
ttccggtgcgccggcgggg

SEQ ID NO: 6046 - DNA, 19 bp, Human hepatitis C virus
ctcccccaggcctgtctcc

SEQ ID NO: 6047 - DNA, 19 bp, Human hepatitis C virus
gggggttgcaaaggcggtg

SEQ ID NO: 6048 - DNA, 19 bp, Human hepatitis C virus
tttgtccccgttgagtcca

SEQ ID NO: 6049 - DNA, 19 bp, Human hepatitis C virus
ccgtaccgcaaacattcca

SEQ ID NO: 6050 - DNA, 19 bp, Human hepatitis C virus
caagtggcccatctacacg

SEQ ID NO: 6051 - DNA, 19 bp, Human hepatitis C virus
cacgctcccactggcagcg

SEQ ID NO: 6052 - DNA, 19 bp, Human hepatitis C virus
ccgcatatgcggcccaagg

SEQ ID NO: 6053 - DNA, 19 bp, Human hepatitis C virus
cgtatatgtctaaagcaca

SEQ ID NO: 6054 - DNA, 19 bp, Human hepatitis C virus
gtatatgtctaaagcacat

SEQ ID NO: 6055 - DNA, 19 bp, Human hepatitis C virus
ggaccattaccacgggcgc

SEQ ID NO: 6056 - DNA, 19 bp, Human hepatitis C virus
cccccattacgtactccac

SEQ ID NO: 6057 - DNA, 19 bp, Human hepatitis C virus
agttccttgccgacggtgg

SEQ ID NO: 6058 - DNA, 19 bp, Human hepatitis C virus
gagacggctggagcgcggc

SEQ ID NO: 6059 - DNA, 19 bp, Human hepatitis C virus
caccgctacgcctccagga

SEQ ID NO: 6060 - DNA, 19 bp, Human hepatitis C virus
tggagagatccccttctac

SEQ ID NO: 6061 - DNA, 19 bp, Human hepatitis C virus
agccatccccatcgaagcc

SEQ ID NO: 6062 - DNA, 19 bp, Human hepatitis C virus
tccccatcgaagccatcaa

SEQ ID NO: 6063 - DNA, 19 bp, Human hepatitis C virus
ccccatcgaagccatcaag

SEQ ID NO: 6064 - DNA, 19 bp, Human hepatitis C virus
ggcctcggaatcaatgctg

SEQ ID NO: 6065 - DNA, 19 bp, Human hepatitis C virus
gtccgtcataccgaccagc

SEQ ID NO: 6066 - DNA, 19 bp, Human hepatitis C virus
gtcataccgaccagcggag

SEQ ID NO: 6067 - DNA, 19 bp, Human hepatitis C virus
cgggctataccggtgactt

SEQ ID NO: 6068 - DNA, 19 bp, Human hepatitis C virus
ctttgattcagtgatcgac

SEQ ID NO: 6069 - DNA, 19 bp, Human hepatitis C virus
acagtcgacttcagcttgg

SEQ ID NO: 6070 - DNA, 19 bp, Human hepatitis C virus
cttggaccccaccttcacc

SEQ ID NO: 6071 - DNA, 19 bp, Human hepatitis C virus
gagacgacgaccgtgcccc

SEQ ID NO: 6072 - DNA, 19 bp, Human hepatitis C virus
ggggtaggactggcagggg

SEQ ID NO: 6073 - DNA, 19 bp, Human hepatitis C virus
gggcatatacaggtttgta

SEQ ID NO: 6074 - DNA, 19 bp, Human hepatitis C virus
gggggaacggccctcgggc

SEQ ID NO: 6075 - DNA, 19 bp, Human hepatitis C virus
tgacgcgggctgtgcttgg

SEQ ID NO: 6076 - DNA, 19 bp, Human hepatitis C virus
gacgcgggctgtgcttggt

SEQ ID NO: 6077 - DNA, 19 bp, Human hepatitis C virus
tgcttggtacgagctcacc

SEQ ID NO: 6078 - DNA, 19 bp, Human hepatitis C virus
tgcccacttcctgtcccag

SEQ ID NO: 6079 - DNA, 19 bp, Human hepatitis C virus
ggtggcataccaagccaca

SEQ ID NO: 6080 - DNA, 19 bp, Human hepatitis C virus
gggctcaggccccacctcc

SEQ ID NO: 6081 - DNA, 19 bp, Human hepatitis C virus
ccatcgtgggatcaaatgt

SEQ ID NO: 6082 - DNA, 19 bp, Human hepatitis C virus
tcatacggctaaaacccac

SEQ ID NO: 6083 - DNA, 19 bp, Human hepatitis C virus
tgctgtataggctaggggc

SEQ ID NO: 6084 - DNA, 19 bp, Human hepatitis C virus
ccaaatacatcatggcatg

SEQ ID NO: 6085 - DNA, 19 bp, Human hepatitis C virus
ggagtcctcgcagctctgg

SEQ ID NO: 6086 - DNA, 19 bp, Human hepatitis C virus
gcctgacaacaggcagtgt

SEQ ID NO: 6087 - DNA, 19 bp, Human hepatitis C virus
agccaccaagcaggcggag

SEQ ID NO: 6088 - DNA, 19 bp, Human hepatitis C virus
catgtggaatttcatcagc

SEQ ID NO: 6089 - DNA, 19 bp, Human hepatitis C virus
ctctatcaccagcccgctc

SEQ ID NO: 6090 - DNA, 19 bp, Human hepatitis C virus
cccagaacaccctcctgtt

SEQ ID NO: 6091 - DNA, 19 bp, Human hepatitis C virus
ctcctgtttaacatcttgg

SEQ ID NO: 6092 - DNA, 19 bp, Human hepatitis C virus
ttgggggggtgggtagccg

SEQ ID NO: 6093 - DNA, 19 bp, Human hepatitis C virus
tgcttcggctttcgtgggc

SEQ ID NO: 6094 - DNA, 19 bp, Human hepatitis C virus
tcgtgggcgctggtatcgc

SEQ ID NO: 6095 - DNA, 19 bp, Human hepatitis C virus
cgctggtgcggctgttggc

SEQ ID NO: 6096 - DNA, 19 bp, Human hepatitis C virus
cggctgttggcagcatagg

SEQ ID NO: 6097 - DNA, 19 bp, Human hepatitis C virus
ggggcaggggtggctggcg

SEQ ID NO: 6098 - DNA, 19 bp, Human hepatitis C virus
ctggcgcgctcgtggcctt

SEQ ID NO: 6099 - DNA, 19 bp, Human hepatitis C virus
tggcgcgctcgtggccttc

SEQ ID NO: 6100 - DNA, 19 bp, Human hepatitis C virus
gagcggcgaggcgccctct

SEQ ID NO: 6101 - DNA, 19 bp, Human hepatitis C virus
tgggcccgggagagggggc

SEQ ID NO: 6102 - DNA, 19 bp, Human hepatitis C virus
cggctgatagcgttcgctt

SEQ ID NO: 6103 - DNA, 19 bp, Human hepatitis C virus
gtgcctgagagcgacgccg

SEQ ID NO: 6104 - DNA, 19 bp, Human hepatitis C virus
atgaggactgttctacgcc

SEQ ID NO: 6105 - DNA, 19 bp, Human hepatitis C virus
gtccaagctcctgccgcgg

SEQ ID NO: 6106 - DNA, 19 bp, Human hepatitis C virus
acagatcgccggacatgtc

SEQ ID NO: 6107 - DNA, 19 bp, Human hepatitis C virus
acgtggcatggaacattcc

SEQ ID NO: 6108 - DNA, 19 bp, Human hepatitis C virus
gggcccctgcacgccttcc

SEQ ID NO: 6109 - DNA, 19 bp, Human hepatitis C virus
agtgcccatgtcaggttcc

SEQ ID NO: 6110 - DNA, 19 bp, Human hepatitis C virus
tgcccatgtcaggttccag

SEQ ID NO: 6111 - DNA, 19 bp, Human hepatitis C virus
cagctcctgagtttttcac

SEQ ID NO: 6112 - DNA, 19 bp, Human hepatitis C virus
tcacggaggtggatggggt

SEQ ID NO: 6113 - DNA, 19 bp, Human hepatitis C virus
cacggaggtggatggggtg

SEQ ID NO: 6114 - DNA, 19 bp, Human hepatitis C virus
gacccctcccacattacag

SEQ ID NO: 6115 - DNA, 19 bp, Human hepatitis C virus
ttggccagggggtctcccc

SEQ ID NO: 6116 - DNA, 19 bp, Human hepatitis C virus
ccttgagggcgacatgcac

SEQ ID NO: 6117 - DNA, 19 bp, Human hepatitis C virus
ggagatgggcggaaacatc

SEQ ID NO: 6118 - DNA, 19 bp, Human hepatitis C virus
gagatgggcggaaacatca

SEQ ID NO: 6119 - DNA, 19 bp, Human hepatitis C virus
ctagactctttcgagccgc

SEQ ID NO: 6120 - DNA, 19 bp, Human hepatitis C virus
tagactctttcgagccgct

SEQ ID NO: 6121 - DNA, 19 bp, Human hepatitis C virus
agaatgaaatatccattgc

SEQ ID NO: 6122 - DNA, 19 bp, Human hepatitis C virus
ttgcggcggagatcctgcg

SEQ ID NO: 6123 - DNA, 19 bp, Human hepatitis C virus
agcgaggaggctggtgaga

SEQ ID NO: 6124 - DNA, 19 bp, Human hepatitis C virus
tgagagcgtcgtctgctgc

SEQ ID NO: 6125 - DNA, 19 bp, Human hepatitis C virus
gtcgtctgctgctcaatgt

SEQ ID NO: 6126 - DNA, 19 bp, Human hepatitis C virus
tgcgccatcacaacatggt

SEQ ID NO: 6127 - DNA, 19 bp, Human hepatitis C virus
cagaagaaggtcacctttg

SEQ ID NO: 6128 - DNA, 19 bp, Human hepatitis C virus
cctggatgaccattaccgg

SEQ ID NO: 6129 - DNA, 19 bp, Human hepatitis C virus
ggacgtgcttaaggagatg

SEQ ID NO: 6130 - DNA, 19 bp, Human hepatitis C virus
aaagaatgaggttttctgc

SEQ ID NO: 6131 - DNA, 19 bp, Human hepatitis C virus
agttcgtgtatgcgagaag

SEQ ID NO: 6132 - DNA, 19 bp, Human hepatitis C virus
ggctataaaatcgctcaca

SEQ ID NO: 6133 - DNA, 19 bp, Human hepatitis C virus
ttctccatccttctagctc

SEQ ID NO: 6134 - DNA, 19 bp, Human hepatitis C virus
tgtctcgtgcccgaccccg

SEQ ID NO: 6135 - DNA, 19 bp, Human hepatitis C virus
taccatcacccagctgctg

SEQ ID NO: 6136 - DNA, 19 bp, Human hepatitis C virus
ccgggcagcgggtcgagtt

SEQ ID NO: 6137 - DNA, 19 bp, Human hepatitis C virus
tgagagcgacgccgcagcg

SEQ ID NO: 6138 - DNA, 19 bp, Human hepatitis C virus
cggcatgtgggcccgggag

SEQ ID NO: 6139 - DNA, 19 bp, Human hepatitis C virus
cgacccctcccacattaca

SEQ ID NO: 6140 - DNA, 19 bp, Human hepatitis C virus
ccgacccctcccacattac

SEQ ID NO: 6141 - DNA, 19 bp, Human hepatitis C virus
tccggctggttcgttgctg

SEQ ID NO: 6142 - DNA, 19 bp, Human hepatitis C virus
gggtgtgcacggtgttgag

SEQ ID NO: 6143 - DNA, 19 bp, Human hepatitis C virus
tgggcgctggtatcgctgg

SEQ ID NO: 6144 - DNA, 19 bp, Human hepatitis C virus
gagcccgaaccggacgtag

SEQ ID NO: 6145 - DNA, 19 bp, Human hepatitis C virus
cgagcccgaaccggacgta

SEQ ID NO: 6146 - DNA, 19 bp, Human hepatitis C virus
aggctatgactaggtactc

SEQ ID NO: 6147 - DNA, 19 bp, Human hepatitis C virus
tagcgcattttcactccat

SEQ ID NO: 6148 - DNA, 19 bp, Human hepatitis C virus
gttgccgctaccttaggtt

SEQ ID NO: 6149 - DNA, 19 bp, Human hepatitis C virus
caccagcccgctcaccacc

SEQ ID NO: 6150 - DNA, 19 bp, Human hepatitis C virus
tgccaacgtgggtacaagg

SEQ ID NO: 6151 - DNA, 19 bp, Human hepatitis C virus
ctgacgactagctgcggta

SEQ ID NO: 6152 - DNA, 19 bp, Human hepatitis C virus
tgagacgacgaccgtgccc

SEQ ID NO: 6153 - DNA, 19 bp, Human hepatitis C virus
ctggtggccctcaatgcag

SEQ ID NO: 6154 - DNA, 19 bp, Human hepatitis C virus
gttgccgctaccttaggtt

SEQ ID NO: 6155 - DNA, 19 bp, Human hepatitis C virus
acaccacgggcccctgcac

SEQ ID NO: 6156 - DNA, 19 bp, Human hepatitis C virus
tgctcaatgtcctacacat

SEQ ID NO: 6157 - DNA, 19 bp, Human hepatitis C virus
ccaagctcaaactcactcc

SEQ ID NO: 6158 - DNA, 19 bp, Human hepatitis C virus
tgcgagcccgaaccggacg

SEQ ID NO: 6159 - DNA, 19 bp, Human hepatitis C virus
aaggtcacctttgacagac

SEQ ID NO: 6160 - DNA, 19 bp, Human hepatitis C virus
agttcgatgaaatggaaga

SEQ ID NO: 6161 - DNA, 19 bp, Human hepatitis C virus
cgagcaattcaagcagaag

SEQ ID NO: 6162 - DNA, 19 bp, Human hepatitis C virus
tgatcacgccatgcgccgc

SEQ ID NO: 6163 - DNA, 19 bp, Human hepatitis C virus
aggcggtggattttgtccc

SEQ ID NO: 6164 - DNA, 19 bp, Human hepatitis C virus
agcggcacggcgaccgccc

SEQ ID NO: 6165 - DNA, 19 bp, Human hepatitis C virus
cagcggcacggcgaccgcc

SEQ ID NO: 6166 - DNA, 19 bp, Human hepatitis C virus
acaggtgccctgatcacgc

SEQ ID NO: 6167 - DNA, 19 bp, Human hepatitis C virus
gtcttggaagaacccggac

SEQ ID NO: 6168 - DNA, 19 bp, Human hepatitis C virus
ccttcctcaagccgtgatg

SEQ ID NO: 6169 - DNA, 19 bp, Human hepatitis C virus
ccgggggaacggccctcgg

SEQ ID NO: 6170 - DNA, 19 bp, Human hepatitis C virus
aatgttgtgacttggcccc

SEQ ID NO: 6171 - DNA, 19 bp, Human hepatitis C virus
ttctgattgccatactcgg

SEQ ID NO: 6172 - DNA, 19 bp, Human hepatitis C virus
gacgaccttgtcgttatct

SEQ ID NO: 6173 - DNA, 19 bp, Human hepatitis C virus
tggccggcgccccccgggg

SEQ ID NO: 6174 - DNA, 19 bp, Human hepatitis C virus
gcccccccttgagggggag

SEQ ID NO: 6175 - DNA, 19 bp, Human hepatitis C virus
gggcaaaggacgtccggaa

SEQ ID NO: 6176 - DNA, 19 bp, Human hepatitis C virus
tggcgggggcccactgggg

SEQ ID NO: 6177 - DNA, 19 bp, Human hepatitis C virus
tgtcccagggggggagggc

SEQ ID NO: 6178 - DNA, 19 bp, Human hepatitis C virus
gaaaaaggacggttgtcct

SEQ ID NO: 6179 - DNA, 19 bp, Human hepatitis C virus
agaaaaaggacggttgtcc

SEQ ID NO: 6180 - DNA, 19 bp, Human hepatitis C virus
tggtttttttttttttttt

SEQ ID NO: 6181 - DNA, 19 bp, Human hepatitis C virus
gtcctgaacccgtctgttg

SEQ ID NO: 6182 - DNA, 19 bp, Human hepatitis C virus
accattgagacgacgaccg

SEQ ID NO: 6183 - DNA, 19 bp, Human hepatitis C virus
ccccggccacgcgtcaggt

SEQ ID NO: 6184 - DNA, 19 bp, Human hepatitis C virus
ctgggcgcgctgacgggca

SEQ ID NO: 6185 - DNA, 19 bp, Human hepatitis C virus
cacagcctgtctcgtgccc

SEQ ID NO: 6186 - DNA, 19 bp, Human hepatitis C virus
gggtgggtagccgcccaac

SEQ ID NO: 6187 - DNA, 19 bp, Human hepatitis C virus
ggggtgggtagccgcccaa

SEQ ID NO: 6188 - DNA, 19 bp, Human hepatitis C virus
gggggtgggtagccgccca

SEQ ID NO: 6189 - DNA, 19 bp, Human hepatitis C virus
ggcggggcgacaatagagg

SEQ ID NO: 6190 - DNA, 19 bp, Human hepatitis C virus
gtcgtcggagtcgtgtgtg

SEQ ID NO: 6191 - DNA, 19 bp, Human hepatitis C virus
ggggcaaaggacgtccgga

SEQ ID NO: 6192 - DNA, 19 bp, Human hepatitis C virus
ccaagccacagtgtgcgcc

SEQ ID NO: 6193 - DNA, 19 bp, Human hepatitis C virus
gcagcaacacgtggcatgg

SEQ ID NO: 6194 - DNA, 19 bp, Human hepatitis C virus
cctcacaacgggggggcac

SEQ ID NO: 6195 - DNA, 19 bp, Human hepatitis C virus
ccctcacaacgggggggca

SEQ ID NO: 6196 - DNA, 19 bp, Human hepatitis C virus
accctcacaacgggggggc

SEQ ID NO: 6197 - DNA, 19 bp, Human hepatitis C virus
tgggcatcggcacagtcct

SEQ ID NO: 6198 - DNA, 19 bp, Human hepatitis C virus
cgtattcccagatttggga

SEQ ID NO: 6199 - DNA, 19 bp, Human hepatitis C virus
aatcaatgctgtagcgtat

SEQ ID NO: 6200 - DNA, 19 bp, Human hepatitis C virus
gccgccacttgcggcaaat

SEQ ID NO: 6201 - DNA, 19 bp, Human hepatitis C virus
tgccaacgtgggtacaagg

SEQ ID NO: 6202 - DNA, 19 bp, Human hepatitis C virus
cctgccgcggttaccgggt

SEQ ID NO: 6203 - DNA, 19 bp, Human hepatitis C virus
actgcgtcggcatgtgggc

SEQ ID NO: 6204 - DNA, 19 bp, Human hepatitis C virus
ctggtatcgctggtgcggc

SEQ ID NO: 6205 - DNA, 19 bp, Human hepatitis C virus
gggacagatcggagctcag

SEQ ID NO: 6206 - DNA, 19 bp, Human hepatitis C virus
gcggcgagcctacgagtct

SEQ ID NO: 6207 - DNA, 19 bp, Human hepatitis C virus
gctccgggggcgcttacga

SEQ ID NO: 6208 - DNA, 19 bp, Human hepatitis C virus
gataacttcccctacctgg

SEQ ID NO: 6209 - DNA, 19 bp, Human hepatitis C virus
gccgcggttaccgggtgtc

SEQ ID NO: 6210 - DNA, 19 bp, Human hepatitis C virus
ggggtctcccccctccttg

SEQ ID NO: 6211 - DNA, 19 bp, Human hepatitis C virus
acgggcgcccccattacgt

SEQ ID NO: 6212 - DNA, 19 bp, Human hepatitis C virus
ggccgctgtatgcacccgg

SEQ ID NO: 6213 - DNA, 19 bp, Human hepatitis C virus
cattatgtccaaatggcct

SEQ ID NO: 6214 - DNA, 19 bp, Human hepatitis C virus
tccaagtggcccatctaca

SEQ ID NO: 6215 - DNA, 19 bp, Human hepatitis C virus
agggcaggggtggcgactc

SEQ ID NO: 6216 - DNA, 19 bp, Human hepatitis C virus
cccaccttatgggcaagga

SEQ ID NO: 6217 - DNA, 19 bp, Human hepatitis C virus
ggcgtccacagtcaaggct

SEQ ID NO: 6218 - DNA, 19 bp, Human hepatitis C virus
atagaagaagcctgccgcc

SEQ ID NO: 6219 - DNA, 19 bp, Human hepatitis C virus
catagaagaagcctgccgc

SEQ ID NO: 6220 - DNA, 19 bp, Human hepatitis C virus
ccatagaagaagcctgccg

SEQ ID NO: 6221 - DNA, 19 bp, Human hepatitis C virus
ggggggacggcatcatgca

SEQ ID NO: 6222 - DNA, 19 bp, Human hepatitis C virus
ccccaatcgatgaacgggg

SEQ ID NO: 6223 - DNA, 19 bp, Human hepatitis C virus
ggaggccgcaagccagccc

SEQ ID NO: 6224 - DNA, 19 bp, Human hepatitis C virus
atggtaccgaccctaacat

SEQ ID NO: 6225 - DNA, 19 bp, Human hepatitis C virus
catggtaccgaccctaaca

SEQ ID NO: 6226 - DNA, 19 bp, Human hepatitis C virus
tgcacgatgctcgtgaacg

SEQ ID NO: 6227 - DNA, 19 bp, Human hepatitis C virus
tgccgcggttaccgggtgt

SEQ ID NO: 6228 - DNA, 19 bp, Human hepatitis C virus
ctgccgcggttaccgggtg

SEQ ID NO: 6229 - DNA, 19 bp, Human hepatitis C virus
ccaggattgcccgtttgcc

SEQ ID NO: 6230 - DNA, 19 bp, Human hepatitis C virus
gctccccccagcgctgctt

SEQ ID NO: 6231 - DNA, 19 bp, Human hepatitis C virus
gcacggcgaccgcccctcc

SEQ ID NO: 6232 - DNA, 19 bp, Human hepatitis C virus
tccccccagcgctgcttcg

SEQ ID NO: 6233 - DNA, 19 bp, Human hepatitis C virus
gccggattacaatcctcca

SEQ ID NO: 6234 - DNA, 19 bp, Human hepatitis C virus
actcgcgatcccaccaccc

SEQ ID NO: 6235 - DNA, 19 bp, Human hepatitis C virus
acaacatggtctacgccac

SEQ ID NO: 6236 - DNA, 19 bp, Human hepatitis C virus
ctgcacgccttccccggcg

SEQ ID NO: 6237 - DNA, 19 bp, Human hepatitis C virus
gctcctcatacggattcca

SEQ ID NO: 6238 - DNA, 19 bp, Human hepatitis C virus
aggtgccctgatcacgcca

SEQ ID NO: 6239 - DNA, 19 bp, Human hepatitis C virus
ttctggcgggctatggggc

SEQ ID NO: 6240 - DNA, 19 bp, Human hepatitis C virus
caggctataaaatcgctca

SEQ ID NO: 6241 - DNA, 19 bp, Human hepatitis C virus
atggtaccgaccctaacat

SEQ ID NO: 6242 - DNA, 19 bp, Human hepatitis C virus
tgttcctccaatgtgtcgg

SEQ ID NO: 6243 - DNA, 19 bp, Human hepatitis C virus
cttgaaagcctctgccgcc

SEQ ID NO: 6244 - DNA, 19 bp, Human hepatitis C virus
tgtctcctacttgaagggc

SEQ ID NO: 6245 - DNA, 19 bp, Human hepatitis C virus
ctccggtggtacacgggtg

SEQ ID NO: 6246 - DNA, 19 bp, Human hepatitis C virus
ttcatgctgtgcctactcc

SEQ ID NO: 6247 - DNA, 19 bp, Human hepatitis C virus
cccagggggggagggccgc

SEQ ID NO: 6248 - DNA, 19 bp, Human hepatitis C virus
gggccgccacttgcggcaa

SEQ ID NO: 6249 - DNA, 19 bp, Human hepatitis C virus
gctcccggcctagttgggg

SEQ ID NO: 6250 - DNA, 19 bp, Human hepatitis C virus
gtaggactggcaggggcag

SEQ ID NO: 6251 - DNA, 19 bp, Human hepatitis C virus
atcattgaacgactccatg

SEQ ID NO: 6252 - DNA, 19 bp, Human hepatitis C virus
gatcattgaacgactccat

SEQ ID NO: 6253 - DNA, 19 bp, Human hepatitis C virus
ggagcaacttgaaaaagcc

SEQ ID NO: 6254 - DNA, 19 bp, Human hepatitis C virus
agggccttggcacatggtg

SEQ ID NO: 6255 - DNA, 19 bp, Human hepatitis C virus
ggcgtgctgacgactagct

SEQ ID NO: 6256 - DNA, 19 bp, Human hepatitis C virus
ctggtgcggctgttggcag

SEQ ID NO: 6257 - DNA, 19 bp, Human hepatitis C virus
tgctgcgccatcacaacat

SEQ ID NO: 6258 - DNA, 19 bp, Human hepatitis C virus
gcccaactcgctcccccca

SEQ ID NO: 6259 - DNA, 19 bp, Human hepatitis C virus
aggcaggagataacttccc

SEQ ID NO: 6260 - DNA, 19 bp, Human hepatitis C virus
ggcccctgcacgccttccc

SEQ ID NO: 6261 - DNA, 19 bp, Human hepatitis C virus
atggtctacgccacgacat

SEQ ID NO: 6262 - DNA, 19 bp, Human hepatitis C virus
tgggtacaagggagtctgg

SEQ ID NO: 6263 - DNA, 19 bp, Human hepatitis C virus
tgtcccagggggggagggc

SEQ ID NO: 6264 - DNA, 19 bp, Human hepatitis C virus
gcccgagggcagggcctgg

SEQ ID NO: 6265 - DNA, 19 bp, Human hepatitis C virus
cagggccttggcacatggt

SEQ ID NO: 6266 - DNA, 19 bp, Human hepatitis C virus
gaggccgcgatgccatcat

SEQ ID NO: 6267 - DNA, 19 bp, Human hepatitis C virus
gggggacggcatcatgcac

SEQ ID NO: 6268 - DNA, 19 bp, Human hepatitis C virus
ggggggacggcatcatgca

SEQ ID NO: 6269 - DNA, 19 bp, Human hepatitis C virus
ccggctggttcgttgctgg

SEQ ID NO: 6270 - DNA, 19 bp, Human hepatitis C virus
ctctcatgccaacgtgggt

SEQ ID NO: 6271 - DNA, 19 bp, Human hepatitis C virus
tggcaatgagggcatgggg

SEQ ID NO: 6272 - DNA, 19 bp, Human hepatitis C virus
actatgcggtccccggtct

SEQ ID NO: 6273 - DNA, 19 bp, Human hepatitis C virus
gaccaggatctcgtcggct

SEQ ID NO: 6274 - DNA, 19 bp, Human hepatitis C virus
cggggccttggttgacacc

SEQ ID NO: 6275 - DNA, 19 bp, Human hepatitis C virus
gacccccggcgtaggtcgc

SEQ ID NO: 6276 - DNA, 19 bp, Human hepatitis C virus
cgtgcaatacctgtacggt

SEQ ID NO: 6277 - DNA, 19 bp, Human hepatitis C virus
gatcatgcatactcccggg

SEQ ID NO: 6278 - DNA, 19 bp, Human hepatitis C virus
cctgcacgccttccccggc

SEQ ID NO: 6279 - DNA, 19 bp, Human hepatitis C virus
ctgtatgcacccggggggt

SEQ ID NO: 6280 - DNA, 19 bp, Human hepatitis C virus
gctgtatgcacccgggggg

SEQ ID NO: 6281 - DNA, 19 bp, Human hepatitis C virus
cgagggcagggcctgggct

SEQ ID NO: 6282 - DNA, 19 bp, Human hepatitis C virus
cggctgtcgttcccgatag

SEQ ID NO: 6283 - DNA, 19 bp, Human hepatitis C virus
ccggctgtcgttcccgata

SEQ ID NO: 6284 - DNA, 19 bp, Human hepatitis C virus
gaggccgcaagccagcccg

SEQ ID NO: 6285 - DNA, 19 bp, Human hepatitis C virus
catcgataccctcacatgc

SEQ ID NO: 6286 - DNA, 19 bp, Human hepatitis C virus
gagctgcaaagctccagga

SEQ ID NO: 6287 - DNA, 19 bp, Human hepatitis C virus
ccggccgcatatgcggccc

SEQ ID NO: 6288 - DNA, 19 bp, Human hepatitis C virus
gccggccgcatatgcggcc

SEQ ID NO: 6289 - DNA, 19 bp, Human hepatitis C virus
catgaggatcatcgggccg

SEQ ID NO: 6290 - DNA, 19 bp, Human hepatitis C virus
ccatgaggatcatcgggcc

SEQ ID NO: 6291 - DNA, 19 bp, Human hepatitis C virus
cagctccgaattgtcggcc

SEQ ID NO: 6292 - DNA, 19 bp, Human hepatitis C virus
acccacgctgcacgggcca

SEQ ID NO: 6293 - DNA, 19 bp, Human hepatitis C virus
cagcataggtcttgggaag

SEQ ID NO: 6294 - DNA, 19 bp, Human hepatitis C virus
agcagtgctcacttccatg

SEQ ID NO: 6295 - DNA, 19 bp, Human hepatitis C virus
tgatggcattcacagcctc

SEQ ID NO: 6296 - DNA, 19 bp, Human hepatitis C virus
tattaccggggtcttgatg

SEQ ID NO: 6297 - DNA, 19 bp, Human hepatitis C virus
gggctgcgtgggaaacagc

SEQ ID NO: 6298 - DNA, 19 bp, Human hepatitis C virus
tgtctcctacttgaagggc

SEQ ID NO: 6299 - DNA, 19 bp, Human hepatitis C virus
atcaatttgctccctgcca

SEQ ID NO: 6300 - DNA, 19 bp, Human hepatitis C virus
atgtttgggactgggtgtg

SEQ ID NO: 6301 - DNA, 19 bp, Human hepatitis C virus
caccaagcaggcggaggct

SEQ ID NO: 6302 - DNA, 19 bp, Human hepatitis C virus
ccagggctcaggccccacc

SEQ ID NO: 6303 - DNA, 19 bp, Human hepatitis C virus
gactaggtactccgccccc

SEQ ID NO: 6304 - DNA, 19 bp, Human hepatitis C virus
tagcagtgctcacttccat

SEQ ID NO: 6305 - DNA, 19 bp, Human hepatitis C virus
aaagcaagctgcccatcaa

SEQ ID NO: 6306 - DNA, 19 bp, Human hepatitis C virus
gcagaaggcgctcgggttg

SEQ ID NO: 6307 - DNA, 19 bp, Human hepatitis C virus
ctggacccgaggagagcgt

SEQ ID NO: 6308 - DNA, 19 bp, Human hepatitis C virus
tatatcgggggtcccctga

SEQ ID NO: 6309 - DNA, 19 bp, Human hepatitis C virus
tgtggctcggggccttggt

SEQ ID NO: 6310 - DNA, 19 bp, Human hepatitis C virus
atgtggctcggggccttgg

SEQ ID NO: 6311 - DNA, 19 bp, Human hepatitis C virus
tcaggactggggtaaggac

SEQ ID NO: 6312 - DNA, 19 bp, Human hepatitis C virus
gggtggcttcatgcctcag

SEQ ID NO: 6313 - DNA, 19 bp, Human hepatitis C virus
acactccagttaactcctg

SEQ ID NO: 6314 - DNA, 19 bp, Human hepatitis C virus
agcagggccatcaaccaca

SEQ ID NO: 6315 - DNA, 19 bp, Human hepatitis C virus
acagcagaggcggctaagc

SEQ ID NO: 6316 - DNA, 19 bp, Human hepatitis C virus
gttgcaacttggacgacag

SEQ ID NO: 6317 - DNA, 19 bp, Human hepatitis C virus
ccagttggacttatccggc

SEQ ID NO: 6318 - DNA, 19 bp, Human hepatitis C virus
tacacgggtgcccattgcc

SEQ ID NO: 6319 - DNA, 19 bp, Human hepatitis C virus
gtacacgggtgcccattgc

SEQ ID NO: 6320 - DNA, 19 bp, Human hepatitis C virus
ccccaatcgatgaacgggg

SEQ ID NO: 6321 - DNA, 19 bp, Human hepatitis C virus
gtgctggtaggcggagtcc

SEQ ID NO: 6322 - DNA, 19 bp, Human hepatitis C virus
ggtgctggtaggcggagtc

SEQ ID NO: 6323 - DNA, 19 bp, Human hepatitis C virus
gcctacgagtcttcacgga

SEQ ID NO: 6324 - DNA, 19 bp, Human hepatitis C virus
cccgggcagcgggtcgagt

SEQ ID NO: 6325 - DNA, 19 bp, Human hepatitis C virus
ctagccggcccaaaaggcc

SEQ ID NO: 6326 - DNA, 19 bp, Human hepatitis C virus
caagccgtgatgggctcct

SEQ ID NO: 6327 - DNA, 19 bp, Human hepatitis C virus
gctgggggtcattatgtcc

SEQ ID NO: 6328 - DNA, 19 bp, Human hepatitis C virus
cgggtggcccactgctctg

SEQ ID NO: 6329 - DNA, 19 bp, Human hepatitis C virus
cagctgctgaagaggctcc

SEQ ID NO: 6330 - DNA, 19 bp, Human hepatitis C virus
ggactgggtgtgcacggtg

SEQ ID NO: 6331 - DNA, 19 bp, Human hepatitis C virus
aagcaggcggaggctgccg

SEQ ID NO: 6332 - DNA, 19 bp, Human hepatitis C virus
gtccccgttgagtccatgg

SEQ ID NO: 6333 - DNA, 19 bp, Human hepatitis C virus
aaggatgattctgatgacc

SEQ ID NO: 6334 - DNA, 19 bp, Human hepatitis C virus
ccagttggacttatccggc

SEQ ID NO: 6335 - DNA, 19 bp, Human hepatitis C virus
ccaccaagcaggcggaggc

SEQ ID NO: 6336 - DNA, 19 bp, Human hepatitis C virus
ggattgggcccacgccggc

SEQ ID NO: 6337 - DNA, 19 bp, Human hepatitis C virus
cgccacgacatcccgcagc

SEQ ID NO: 6338 - DNA, 19 bp, Human hepatitis C virus
tggcaacagacgctctaat

SEQ ID NO: 6339 - DNA, 19 bp, Human hepatitis C virus
acacaatctttcctggcga

SEQ ID NO: 6340 - DNA, 19 bp, Human hepatitis C virus
aacacaatctttcctggcg

SEQ ID NO: 6341 - DNA, 19 bp, Human hepatitis C virus
catcggcacagtcctggac

SEQ ID NO: 6342 - DNA, 19 bp, Human hepatitis C virus
caatttaccaatgttgtga

SEQ ID NO: 6343 - DNA, 19 bp, Human hepatitis C virus
taggctaggggccgtccaa

SEQ ID NO: 6344 - DNA, 19 bp, Human hepatitis C virus
ctactcctactttctgtag

SEQ ID NO: 6345 - DNA, 19 bp, Human hepatitis C virus
tgtcctacacatggacagg

SEQ ID NO: 6346 - DNA, 19 bp, Human hepatitis C virus
atgtcctacacatggacag

SEQ ID NO: 6347 - DNA, 19 bp, Human hepatitis C virus
gcggggtaggactggcagg

SEQ ID NO: 6348 - DNA, 19 bp, Human hepatitis C virus
cgcccaactcgctcccccc

SEQ ID NO: 6349 - DNA, 19 bp, Human hepatitis C virus
gatgttattccggtgcgcc

SEQ ID NO: 6350 - DNA, 19 bp, Human hepatitis C virus
agacgacgaccgtgcccca

SEQ ID NO: 6351 - DNA, 19 bp, Human hepatitis C virus
ctccacctatggcaagttc

SEQ ID NO: 6352 - DNA, 19 bp, Human hepatitis C virus
ccacctgtcaaggcccctc

SEQ ID NO: 6353 - DNA, 19 bp, Human hepatitis C virus
catcccgcagcgcgggcct

SEQ ID NO: 6354 - DNA, 19 bp, Human hepatitis C virus
acatcccgcagcgcgggcc

SEQ ID NO: 6355 - DNA, 19 bp, Human hepatitis C virus
gccaataggccatttcctg

SEQ ID NO: 6356 - DNA, 19 bp, Human hepatitis C virus
ggccaataggccatttcct

SEQ ID NO: 6357 - DNA, 19 bp, Human hepatitis C virus
ggaacctatccagcagggc

SEQ ID NO: 6358 - DNA, 19 bp, Human hepatitis C virus
tccggtggtacacgggtgc

SEQ ID NO: 6359 - DNA, 19 bp, Human hepatitis C virus
aaggcaaaggcgtccacag

SEQ ID NO: 6360 - DNA, 19 bp, Human hepatitis C virus
ccctgcctgggaaccccgc

SEQ ID NO: 6361 - DNA, 19 bp, Human hepatitis C virus
ctggttgggtcacagctcc

SEQ ID NO: 6362 - DNA, 19 bp, Human hepatitis C virus
cctggttgggtcacagctc

SEQ ID NO: 6363 - DNA, 19 bp, Human hepatitis C virus
cccgtggtggagtccaagt

SEQ ID NO: 6364 - DNA, 19 bp, Human hepatitis C virus
catggtctacgccacgaca

SEQ ID NO: 6365 - DNA, 19 bp, Human hepatitis C virus
gggaaggcacctcattttc

SEQ ID NO: 6366 - DNA, 19 bp, Human hepatitis C virus
ggggggcatatacaggttt

SEQ ID NO: 6367 - DNA, 19 bp, Human hepatitis C virus
ttgccaggaccatctggag

SEQ ID NO: 6368 - DNA, 19 bp, Human hepatitis C virus
tgctcgccaccgctacgcc

SEQ ID NO: 6369 - DNA, 19 bp, Human hepatitis C virus
gtgctcgccaccgctacgc

SEQ ID NO: 6370 - DNA, 19 bp, Human hepatitis C virus
ggtaaccatgtctccccca

SEQ ID NO: 6371 - DNA, 19 bp, Human hepatitis C virus
gggcgctggtatcgctggt

SEQ ID NO: 6372 - DNA, 19 bp, Human hepatitis C virus
ttgccccaaccagaatacg

SEQ ID NO: 6373 - DNA, 19 bp, Human hepatitis C virus
tccgtgagccgcatgactg

SEQ ID NO: 6374 - DNA, 19 bp, Human hepatitis C virus
atgagcggcgaggcgccct

SEQ ID NO: 6375 - DNA, 19 bp, Human hepatitis C virus
cgcatgactgcagagagtg

SEQ ID NO: 6376 - DNA, 19 bp, Human hepatitis C virus
aatacgacttggagttgat

SEQ ID NO: 6377 - DNA, 19 bp, Human hepatitis C virus
gtctcccccacgcactatg

SEQ ID NO: 6378 - DNA, 19 bp, Human hepatitis C virus
ccctgccatcctctctcct

SEQ ID NO: 6379 - DNA, 19 bp, Human hepatitis C virus
atgctcaccgacccctccc

SEQ ID NO: 6380 - DNA, 19 bp, Human hepatitis C virus
gaggccgcaagccagcccg

SEQ ID NO: 6381 - DNA, 19 bp, Human hepatitis C virus
cggggacttgccccaacca

SEQ ID NO: 6382 - DNA, 19 bp, Human hepatitis C virus
ggtggctccatcttagccc

SEQ ID NO: 6383 - DNA, 19 bp, Human hepatitis C virus
tggtggctccatcttagcc

SEQ ID NO: 6384 - DNA, 19 bp, Human hepatitis C virus
aggttggccagggggtctc

SEQ ID NO: 6385 - DNA, 19 bp, Human hepatitis C virus
atccaagtttggctatggg

SEQ ID NO: 6386 - DNA, 19 bp, Human hepatitis C virus
ggcctctctgcagatcatg

SEQ ID NO: 6387 - DNA, 19 bp, Human hepatitis C virus
gacgcccccacattcggcc

SEQ ID NO: 6388 - DNA, 19 bp, Human hepatitis C virus
tgacgcccccacattcggc

SEQ ID NO: 6389 - DNA, 19 bp, Human hepatitis C virus
gtgcccatgtcaggttcca

SEQ ID NO: 6390 - DNA, 19 bp, Human hepatitis C virus
cctacacatggacaggtgc

SEQ ID NO: 6391 - DNA, 19 bp, Human hepatitis C virus
gatcatcgggccgaaaacc

SEQ ID NO: 6392 - DNA, 19 bp, Human hepatitis C virus
agagcggctttatatcggg

SEQ ID NO: 6393 - DNA, 19 bp, Human hepatitis C virus
ggcgcgctcgtggccttca

SEQ ID NO: 6394 - DNA, 19 bp, Human hepatitis C virus
tccattgttagagtcttgg

SEQ ID NO: 6395 - DNA, 19 bp, Human hepatitis C virus
actgcacgatgctcgtgaa

SEQ ID NO: 6396 - DNA, 19 bp, Human hepatitis C virus
caggggtggctggcgcgct

SEQ ID NO: 6397 - DNA, 19 bp, Human hepatitis C virus
tgggcgctggtatcgctgg

SEQ ID NO: 6398 - DNA, 19 bp, Human hepatitis C virus
cagcagggccatcaaccac

SEQ ID NO: 6399 - DNA, 19 bp, Human hepatitis C virus
atgtggtctccacccttcc

SEQ ID NO: 6400 - DNA, 19 bp, Human hepatitis C virus
cgcccctcctgaccagacc

SEQ ID NO: 6401 - DNA, 19 bp, Human hepatitis C virus
cctccttgagggcgacatg

SEQ ID NO: 6402 - DNA, 19 bp, Human hepatitis C virus
ccctccttgagggcgacat

SEQ ID NO: 6403 - DNA, 19 bp, Human hepatitis C virus
tcatgctcctctatgcccc

SEQ ID NO: 6404 - DNA, 19 bp, Human hepatitis C virus
taccaccacgagcttacgc

SEQ ID NO: 6405 - DNA, 19 bp, Human hepatitis C virus
gggggagccgggggacccc

SEQ ID NO: 6406 - DNA, 19 bp, Human hepatitis C virus
cttcgagcggagggggatg

SEQ ID NO: 6407 - DNA, 19 bp, Human hepatitis C virus
cacggcgaccgcccctcct

SEQ ID NO: 6408 - DNA, 19 bp, Human hepatitis C virus
actgcacgatgctcgtgaa

SEQ ID NO: 6409 - DNA, 19 bp, Human hepatitis C virus
ccgggacgtgcttaaggag

SEQ ID NO: 6410 - DNA, 19 bp, Human hepatitis C virus
cgtggaggtcacgcgggtg

SEQ ID NO: 6411 - DNA, 19 bp, Human hepatitis C virus
cccctccaataccacctcc

SEQ ID NO: 6412 - DNA, 19 bp, Human hepatitis C virus
cccctcctgaccagacctc

SEQ ID NO: 6413 - DNA, 19 bp, Human hepatitis C virus
aggagatgggcggaaacat

SEQ ID NO: 6414 - DNA, 19 bp, Human hepatitis C virus
gccgtgatgggctcctcat

SEQ ID NO: 6415 - DNA, 19 bp, Human hepatitis C virus
caagtggcgagctttggag

SEQ ID NO: 6416 - DNA, 19 bp, Human hepatitis C virus
tgactaattcaaaagggca

SEQ ID NO: 6417 - DNA, 19 bp, Human hepatitis C virus
ttttttccctctttatggt

SEQ ID NO: 6418 - DNA, 19 bp, Human hepatitis C virus
ttttccctctttatggtgg

SEQ ID NO: 6419 - DNA, 19 bp, Human hepatitis C virus
cctttgacagactgcaggt

SEQ ID NO: 6420 - DNA, 19 bp, Human hepatitis C virus
ggagctcgctaccaaaacc

SEQ ID NO: 6421 - DNA, 19 bp, Human hepatitis C virus
tgtcctacacatggacagg

SEQ ID NO: 6422 - DNA, 19 bp, Human hepatitis C virus
cgttgagcaactctttgct

SEQ ID NO: 6423 - DNA, 19 bp, Human hepatitis C virus
gtcccagttggacttatcc

SEQ ID NO: 6424 - DNA, 19 bp, Human hepatitis C virus
aaaaagccctggattgcca

SEQ ID NO: 6425 - DNA, 19 bp, Human hepatitis C virus
gaaaaagccctggattgcc

SEQ ID NO: 6426 - DNA, 19 bp, Human hepatitis C virus
ggaagaaagcaagctgccc

SEQ ID NO: 6427 - DNA, 19 bp, Human hepatitis C virus
ggtaccgcccttgcgagtc

SEQ ID NO: 6428 - DNA, 19 bp, Human hepatitis C virus
ggggtaccgcccttgcgag

SEQ ID NO: 6429 - DNA, 19 bp, Human hepatitis C virus
gggtcagcggttgtctcct

SEQ ID NO: 6430 - DNA, 19 bp, Human hepatitis C virus
tgagatcaatagggtggct

SEQ ID NO: 6431 - DNA, 19 bp, Human hepatitis C virus
actcgcgatcccaccaccc

SEQ ID NO: 6432 - DNA, 19 bp, Human hepatitis C virus
ctggcgggctatggggcag

SEQ ID NO: 6433 - DNA, 19 bp, Human hepatitis C virus
gcccactggggagtcctgg

SEQ ID NO: 6434 - DNA, 19 bp, Human hepatitis C virus
gggggtctcccccctcctt

SEQ ID NO: 6435 - DNA, 19 bp, Human hepatitis C virus
gccgcaaagctgtcaggcc

SEQ ID NO: 6436 - DNA, 19 bp, Human hepatitis C virus
tgataacatcatgttcctc

SEQ ID NO: 6437 - DNA, 19 bp, Human hepatitis C virus
gtaggcggagtcctcgcag

SEQ ID NO: 6438 - DNA, 19 bp, Human hepatitis C virus
caagtggcgagctttggag

SEQ ID NO: 6439 - DNA, 19 bp, Human hepatitis C virus
acctcagatcattgaacga

SEQ ID NO: 6440 - DNA, 19 bp, Human hepatitis C virus
gggggagggccgccacttg

SEQ ID NO: 6441 - DNA, 19 bp, Human hepatitis C virus
tccaggccaataggccatt

SEQ ID NO: 6442 - DNA, 19 bp, Human hepatitis C virus
ggactacgtccctccggtg

SEQ ID NO: 6443 - DNA, 19 bp, Human hepatitis C virus
aacagccaccaagcaggcg

SEQ ID NO: 6444 - DNA, 19 bp, Human hepatitis C virus
tcccagatttgggagttcg

SEQ ID NO: 6445 - DNA, 19 bp, Human hepatitis C virus
tgggtacaagggagtctgg

SEQ ID NO: 6446 - DNA, 19 bp, Human hepatitis C virus
ggagacatatatcacagcc

SEQ ID NO: 6447 - DNA, 19 bp, Human hepatitis C virus
ggagacatcgggccaggag

SEQ ID NO: 6448 - DNA, 19 bp, Human hepatitis C virus
gggagttcgatgaaatgga

SEQ ID NO: 6449 - DNA, 19 bp, Human hepatitis C virus
aggggccccaggttgggtg

SEQ ID NO: 6450 - DNA, 19 bp, Human hepatitis C virus
gttctggaggacggcgtga

SEQ ID NO: 6451 - DNA, 19 bp, Human hepatitis C virus
cacgctgcacgggccaacg

SEQ ID NO: 6452 - DNA, 19 bp, Human hepatitis C virus
tcctgttgtcgtggggaca

SEQ ID NO: 6453 - DNA, 19 bp, Human hepatitis C virus
gctcccggcctagttgggg

SEQ ID NO: 6454 - DNA, 19 bp, Human hepatitis C virus
cagatcattgaacgactcc

SEQ ID NO: 6455 - DNA, 19 bp, Human hepatitis C virus
ccgctgctgggtagcgctc

SEQ ID NO: 6456 - DNA, 19 bp, Human hepatitis C virus
cacccatatagatgcccac

SEQ ID NO: 6457 - DNA, 19 bp, Human hepatitis C virus
ctggcgggccttgcctact

SEQ ID NO: 6458 - DNA, 19 bp, Human hepatitis C virus
gttgagtgacttcaagacc

SEQ ID NO: 6459 - DNA, 19 bp, Human hepatitis C virus
gagcggagggggatgagaa

SEQ ID NO: 6460 - DNA, 19 bp, Human hepatitis C virus
caaagactccgacgctgag

SEQ ID NO: 6461 - DNA, 19 bp, Human hepatitis C virus
acgcggccgccgcaaggca

SEQ ID NO: 6462 - DNA, 19 bp, Human hepatitis C virus
cacgcggccgccgcaaggc

SEQ ID NO: 6463 - DNA, 19 bp, Human hepatitis C virus
ggggacaaccgatcgtctc

SEQ ID NO: 6464 - DNA, 19 bp, Human hepatitis C virus
gcagaagaaggtcaccttt

SEQ ID NO: 6465 - DNA, 19 bp, Human hepatitis C virus
ggcagaagaaggtcacctt

SEQ ID NO: 6466 - DNA, 19 bp, Human hepatitis C virus
ccctaccggctctgtccac

SEQ ID NO: 6467 - DNA, 19 bp, Human hepatitis C virus
tcgccggcccgagggcagg

SEQ ID NO: 6468 - DNA, 19 bp, Human hepatitis C virus
agacgcagtgtcgcgctcg

SEQ ID NO: 6469 - DNA, 19 bp, Human hepatitis C virus
ctaccttaggttttggggc

SEQ ID NO: 6470 - DNA, 19 bp, Human hepatitis C virus
cctgcgttcgggagggtaa

SEQ ID NO: 6471 - DNA, 19 bp, Human hepatitis C virus
ccctgcgttcgggagggta

SEQ ID NO: 6472 - DNA, 19 bp, Human hepatitis C virus
gcccccgaagccagacagg

SEQ ID NO: 6473 - DNA, 19 bp, Human hepatitis C virus
ggcccccgaagccagacag

SEQ ID NO: 6474 - DNA, 19 bp, Human hepatitis C virus
ggggcaaaggacgtccgga

SEQ ID NO: 6475 - DNA, 19 bp, Human hepatitis C virus
cttctctgacatggagacc

SEQ ID NO: 6476 - DNA, 19 bp, Human hepatitis C virus
ccttcaccattgagacgac

SEQ ID NO: 6477 - DNA, 19 bp, Human hepatitis C virus
ggggcgctgccagggcctt

SEQ ID NO: 6478 - DNA, 19 bp, Human hepatitis C virus
gagcacaggcttaatgctg

SEQ ID NO: 6479 - DNA, 19 bp, Human hepatitis C virus
gagcgtcttcacaggcctc

SEQ ID NO: 6480 - DNA, 19 bp, Human hepatitis C virus
gggcatcggcacagtcctg

SEQ ID NO: 6481 - DNA, 19 bp, Human hepatitis C virus
ccggccgcatatgcggccc

SEQ ID NO: 6482 - DNA, 19 bp, Human hepatitis C virus
taccgaccctaacatcagg

SEQ ID NO: 6483 - DNA, 19 bp, Human hepatitis C virus
cctcgccgacctcatgggg

SEQ ID NO: 6484 - DNA, 19 bp, Human hepatitis C virus
ctgcggatctgttttcctc

SEQ ID NO: 6485 - DNA, 19 bp, Human hepatitis C virus
cctgctctttcaccaccct

SEQ ID NO: 6486 - DNA, 19 bp, Human hepatitis C virus
gggtcagcggttgtctcct

SEQ ID NO: 6487 - DNA, 19 bp, Human hepatitis C virus
cgggggcgcttacgacatc

SEQ ID NO: 6488 - DNA, 19 bp, Human hepatitis C virus
cggggcgcgttccctgaca

SEQ ID NO: 6489 - DNA, 19 bp, Human hepatitis C virus
ccggggcgcgttccctgac

SEQ ID NO: 6490 - DNA, 19 bp, Human hepatitis C virus
caacgtccggggaggccgc

SEQ ID NO: 6491 - DNA, 19 bp, Human hepatitis C virus
gccctgtcgaacactggag

SEQ ID NO: 6492 - DNA, 19 bp, Human hepatitis C virus
aggcaacattatcatgtat

SEQ ID NO: 6493 - DNA, 19 bp, Human hepatitis C virus
gggcaaagcacatgtggaa

SEQ ID NO: 6494 - DNA, 19 bp, Human hepatitis C virus
tggcaatgagggcatgggg

SEQ ID NO: 6495 - DNA, 19 bp, Human hepatitis C virus
gggctcattcgtgcatgca

SEQ ID NO: 6496 - DNA, 19 bp, Human hepatitis C virus
taccaccacgagcttacgc

SEQ ID NO: 6497 - DNA, 19 bp, Human hepatitis C virus
cctctatgcccccccttga

SEQ ID NO: 6498 - DNA, 19 bp, Human hepatitis C virus
tcctgtttaacatcttggg

SEQ ID NO: 6499 - DNA, 19 bp, Human hepatitis C virus
atggcatgcatgtcggccg

SEQ ID NO: 6500 - DNA, 19 bp, Human hepatitis C virus
cgtggggacaaccgatcgt

SEQ ID NO: 6501 - DNA, 19 bp, Human hepatitis C virus
gagcaacttgaaaaagccc

SEQ ID NO: 6502 - DNA, 19 bp, Human hepatitis C virus
tccgttgccggagcgcacg

SEQ ID NO: 6503 - DNA, 19 bp, Human hepatitis C virus
ggcgacaatagagggagct

SEQ ID NO: 6504 - DNA, 19 bp, Human hepatitis C virus
ggggagacatatatcacag

SEQ ID NO: 6505 - DNA, 19 bp, Human hepatitis C virus
gtaggactggcaggggcag

SEQ ID NO: 6506 - DNA, 19 bp, Human hepatitis C virus
ccggcccaaaaggcccaat

SEQ ID NO: 6507 - DNA, 19 bp, Human hepatitis C virus
acgccatggaccgggagat

SEQ ID NO: 6508 - DNA, 19 bp, Human hepatitis C virus
gtgatgctactttttgccg

SEQ ID NO: 6509 - DNA, 19 bp, Human hepatitis C virus
catggaaactactatgcgg

SEQ ID NO: 6510 - DNA, 19 bp, Human hepatitis C virus
gggaacccaggaggatgcg

SEQ ID NO: 6511 - DNA, 19 bp, Human hepatitis C virus
gtcgtcaccagcacctggg

SEQ ID NO: 6512 - DNA, 19 bp, Human hepatitis C virus
gcccggagcgcatggccag

SEQ ID NO: 6513 - DNA, 19 bp, Human hepatitis C virus
atagaagaagcctgccgcc

SEQ ID NO: 6514 - DNA, 19 bp, Human hepatitis C virus
gcccccacattcggccaaa

SEQ ID NO: 6515 - DNA, 19 bp, Human hepatitis C virus
ccccaatatcgaggaggtg

SEQ ID NO: 6516 - DNA, 19 bp, Human hepatitis C virus
gcggcacggcgaccgcccc

SEQ ID NO: 6517 - DNA, 19 bp, Human hepatitis C virus
gagggagcttgctctcccc

SEQ ID NO: 6518 - DNA, 19 bp, Human hepatitis C virus
accctcacaacgggggggc

SEQ ID NO: 6519 - DNA, 19 bp, Human hepatitis C virus
tggttatcgtgggtaggat

SEQ ID NO: 6520 - DNA, 19 bp, Human hepatitis C virus
caagcggagacggctggag

SEQ ID NO: 6521 - DNA, 19 bp, Human hepatitis C virus
gctgtgggcgtcttccggg

SEQ ID NO: 6522 - DNA, 19 bp, Human hepatitis C virus
cttggtacatcaagggcag

SEQ ID NO: 6523 - DNA, 19 bp, Human hepatitis C virus
cccaaccagaatacgactt

SEQ ID NO: 6524 - DNA, 19 bp, Human hepatitis C virus
gcatgtgtgggttcccccc

SEQ ID NO: 6525 - DNA, 19 bp, Human hepatitis C virus
ccaggatctcgtcggctgg

SEQ ID NO: 6526 - DNA, 19 bp, Human hepatitis C virus
accaagatcatcacctggg

SEQ ID NO: 6527 - DNA, 19 bp, Human hepatitis C virus
accttcaccattgagacga

SEQ ID NO: 6528 - DNA, 19 bp, Human hepatitis C virus
accatgtctcccccacgca

SEQ ID NO: 6529 - DNA, 19 bp, Human hepatitis C virus
agacgacgaccgtgcccca

SEQ ID NO: 6530 - DNA, 19 bp, Human hepatitis C virus
atcggagctcagcccgctg

SEQ ID NO: 6531 - DNA, 19 bp, Human hepatitis C virus
aacccaggaggatgcggcg

SEQ ID NO: 6532 - DNA, 19 bp, Human hepatitis C virus
gaacccaggaggatgcggc

SEQ ID NO: 6533 - DNA, 19 bp, Human hepatitis C virus
gctataaaatcgctcacag

SEQ ID NO: 6534 - DNA, 19 bp, Human hepatitis C virus
tgctgctcaatgtcctaca

SEQ ID NO: 6535 - DNA, 19 bp, Human hepatitis C virus
cccgctcaccacccagaac

SEQ ID NO: 6536 - DNA, 19 bp, Human hepatitis C virus
ggggaggttcaagtggtct

SEQ ID NO: 6537 - DNA, 19 bp, Human hepatitis C virus
ccccaatcgatgaacgggg

SEQ ID NO: 6538 - DNA, 19 bp, Human hepatitis C virus
ggggacgaccttgtcgtta

SEQ ID NO: 6539 - DNA, 19 bp, Human hepatitis C virus
caggaggatgcggcgagcc

SEQ ID NO: 6540 - DNA, 19 bp, Human hepatitis C virus
tggatggggtgcggttgca

SEQ ID NO: 6541 - DNA, 19 bp, Human hepatitis C virus
gcatcatgcacaccacctg

SEQ ID NO: 6542 - DNA, 19 bp, Human hepatitis C virus
tccatggtcttagcgcatt

SEQ ID NO: 6543 - DNA, 19 bp, Human hepatitis C virus
cgggaccttgcggtagcag

SEQ ID NO: 6544 - DNA, 19 bp, Human hepatitis C virus
ctcttacgggatgaggttg

SEQ ID NO: 6545 - DNA, 19 bp, Human hepatitis C virus
gctctcccccaggcctgtc

SEQ ID NO: 6546 - DNA, 19 bp, Human hepatitis C virus
ggctggagcgcggcttgtc

SEQ ID NO: 6547 - DNA, 19 bp, Human hepatitis C virus
gggccaacgcccctgctgt

SEQ ID NO: 6548 - DNA, 19 bp, Human hepatitis C virus
ggagagggggccgtgcagt

SEQ ID NO: 6549 - DNA, 19 bp, Human hepatitis C virus
gatgatgctgctgatagcc

SEQ ID NO: 6550 - DNA, 19 bp, Human hepatitis C virus
aaaggacggttgtcctgac

SEQ ID NO: 6551 - DNA, 19 bp, Human hepatitis C virus
aaagaccaagctcaaactc

SEQ ID NO: 6552 - DNA, 19 bp, Human hepatitis C virus
atcactgatggcattcaca

SEQ ID NO: 6553 - DNA, 19 bp, Human hepatitis C virus
ttctgattgccatactcgg

SEQ ID NO: 6554 - DNA, 19 bp, Human hepatitis C virus
ttgatatcaccaaacttct

SEQ ID NO: 6555 - DNA, 19 bp, Human hepatitis C virus
ccagatgtacactaatgta

SEQ ID NO: 6556 - DNA, 19 bp, Human hepatitis C virus
aggggtaggcatctacttg

SEQ ID NO: 6557 - DNA, 19 bp, Human hepatitis C virus
gcagtgctcacttccatgc

SEQ ID NO: 6558 - DNA, 19 bp, Human hepatitis C virus
agcagtgctcacttccatg

SEQ ID NO: 6559 - DNA, 19 bp, Human hepatitis C virus
gagggccgccacttgcggc

SEQ ID NO: 6560 - DNA, 19 bp, Human hepatitis C virus
gcacggcgaccgcccctcc

SEQ ID NO: 6561 - DNA, 19 bp, Human hepatitis C virus
ctccaggccaataggccat

SEQ ID NO: 6562 - DNA, 19 bp, Human hepatitis C virus
gaccattaccacgggcgcc

SEQ ID NO: 6563 - DNA, 19 bp, Human hepatitis C virus
ctcacaggccgggacaaga

SEQ ID NO: 6564 - DNA, 19 bp, Human hepatitis C virus
tgaggtcaccctcacacac

SEQ ID NO: 6565 - DNA, 19 bp, Human hepatitis C virus
ccggctcgtggctgaggga

SEQ ID NO: 6566 - DNA, 19 bp, Human hepatitis C virus
ggcctgttactccattgag

SEQ ID NO: 6567 - DNA, 19 bp, Human hepatitis C virus
tggctctctacgatgtggt

SEQ ID NO: 6568 - DNA, 19 bp, Human hepatitis C virus
tatgacacccgctgttttg

SEQ ID NO: 6569 - DNA, 19 bp, Human hepatitis C virus
ggagatcctgcggaagtcc

SEQ ID NO: 6570 - DNA, 19 bp, Human hepatitis C virus
tggaaactactatgcggtc

SEQ ID NO: 6571 - DNA, 19 bp, Human hepatitis C virus
tttctgtaggggtaggcat

SEQ ID NO: 6572 - DNA, 19 bp, Human hepatitis C virus
gaagccagacaggctataa

SEQ ID NO: 6573 - DNA, 19 bp, Human hepatitis C virus
tctcagcgacgggtcttgg

SEQ ID NO: 6574 - DNA, 19 bp, Human hepatitis C virus
gcgctcgtggccttcaagg

SEQ ID NO: 6575 - DNA, 19 bp, Human hepatitis C virus
ctccgcccgaaggggaagg

SEQ ID NO: 6576 - DNA, 19 bp, Human hepatitis C virus
catggtctacgccacgaca

SEQ ID NO: 6577 - DNA, 19 bp, Human hepatitis C virus
ccgccttatcgtattccca

SEQ ID NO: 6578 - DNA, 19 bp, Human hepatitis C virus
gccgcccaactcgctcccc

SEQ ID NO: 6579 - DNA, 19 bp, Human hepatitis C virus
cccatctacacgctcccac

SEQ ID NO: 6580 - DNA, 19 bp, Human hepatitis C virus
gcccatctacacgctccca

SEQ ID NO: 6581 - DNA, 19 bp, Human hepatitis C virus
ggccagggggtctcccccc

SEQ ID NO: 6582 - DNA, 19 bp, Human hepatitis C virus
cctttgacagactgcaggt

SEQ ID NO: 6583 - DNA, 19 bp, Human hepatitis C virus
tccccggtcttcacagaca

SEQ ID NO: 6584 - DNA, 19 bp, Human hepatitis C virus
ggcccatctacacgctccc

SEQ ID NO: 6585 - DNA, 19 bp, Human hepatitis C virus
gcccccccttgagggggag

SEQ ID NO: 6586 - DNA, 19 bp, Human hepatitis C virus
aagaggctccaccagtgga

SEQ ID NO: 6587 - DNA, 19 bp, Human hepatitis C virus
gtcgtcggagtcgtgtgtg

SEQ ID NO: 6588 - DNA, 19 bp, Human hepatitis C virus
cgggttgttgcaaacagcc

SEQ ID NO: 6589 - DNA, 19 bp, Human hepatitis C virus
caggtttgtaactccgggg

SEQ ID NO: 6590 - DNA, 19 bp, Human hepatitis C virus
aggtcacgcgggtggggga

SEQ ID NO: 6591 - DNA, 19 bp, Human hepatitis C virus
ccccgttgagtccatggaa

SEQ ID NO: 6592 - DNA, 19 bp, Human hepatitis C virus
ggagacatcgggccaggag

SEQ ID NO: 6593 - DNA, 19 bp, Human hepatitis C virus
caccctgcctgggaacccc

SEQ ID NO: 6594 - DNA, 19 bp, Human hepatitis C virus
tggagaccttctgggcaaa

SEQ ID NO: 6595 - DNA, 19 bp, Human hepatitis C virus
tggattgccaaatctacgg

SEQ ID NO: 6596 - DNA, 19 bp, Human hepatitis C virus
cgtgggtaggatcatcttg

SEQ ID NO: 6597 - DNA, 19 bp, Human hepatitis C virus
cgctgcttcggctttcgtg

SEQ ID NO: 6598 - DNA, 19 bp, Human hepatitis C virus
ccttcaaggtcatgagcgg

SEQ ID NO: 6599 - DNA, 19 bp, Human hepatitis C virus
tgtggaagtgtctcatacg

SEQ ID NO: 6600 - DNA, 19 bp, Human hepatitis C virus
atgtggaagtgtctcatac

SEQ ID NO: 6601 - DNA, 19 bp, Human hepatitis C virus
gcgcgtgtcactcaggtcc

SEQ ID NO: 6602 - DNA, 19 bp, Human hepatitis C virus
gtgggcccgggagaggggg

SEQ ID NO: 6603 - DNA, 19 bp, Human hepatitis C virus
ccacagtcaaggctaaact

SEQ ID NO: 6604 - DNA, 19 bp, Human hepatitis C virus
gccgggggaccccgatctc

SEQ ID NO: 6605 - DNA, 19 bp, Human hepatitis C virus
tcctacacatggacaggtg

SEQ ID NO: 6606 - DNA, 19 bp, Human hepatitis C virus
gtagcagtgctcacttcca

SEQ ID NO: 6607 - DNA, 19 bp, Human hepatitis C virus
ggctggttcgttgctggct

SEQ ID NO: 6608 - DNA, 19 bp, Human hepatitis C virus
ttgagggggagccggggga

SEQ ID NO: 6609 - DNA, 19 bp, Human hepatitis C virus
cttgagggggagccggggg

SEQ ID NO: 6610 - DNA, 19 bp, Human hepatitis C virus
cagctccgaattgtcggcc

SEQ ID NO: 6611 - DNA, 19 bp, Human hepatitis C virus
gctgagggatgtttgggac

SEQ ID NO: 6612 - DNA, 19 bp, Human hepatitis C virus
ctccattgagccacttgac

SEQ ID NO: 6613 - DNA, 19 bp, Human hepatitis C virus
aagtccaagaagttccccg

SEQ ID NO: 6614 - DNA, 19 bp, Human hepatitis C virus
gtcgagttcctggtaaaag

SEQ ID NO: 6615 - DNA, 19 bp, Human hepatitis C virus
ccaaatctacggggcctgt

SEQ ID NO: 6616 - DNA, 19 bp, Human hepatitis C virus
ggtgttgagtgacttcaag

SEQ ID NO: 6617 - DNA, 19 bp, Human hepatitis C virus
ggggacaaccgatcgtctc

SEQ ID NO: 6618 - DNA, 19 bp, Human hepatitis C virus
ccccccggggacttgcccc

SEQ ID NO: 6619 - DNA, 19 bp, Human hepatitis C virus
tacacatggacaggtgccc

SEQ ID NO: 6620 - DNA, 19 bp, Human hepatitis C virus
gcccctgcacgccttcccc

SEQ ID NO: 6621 - DNA, 19 bp, Human hepatitis C virus
ccaattgacaccaccgtca

SEQ ID NO: 6622 - DNA, 19 bp, Human hepatitis C virus
accaattgacaccaccgtc

SEQ ID NO: 6623 - DNA, 19 bp, Human hepatitis C virus
ggtgcggctgttggcagca

SEQ ID NO: 6624 - DNA, 19 bp, Human hepatitis C virus
ctgggcgcgctgacgggca

SEQ ID NO: 6625 - DNA, 19 bp, Human hepatitis C virus
tgtgacaccaattgacacc

SEQ ID NO: 6626 - DNA, 19 bp, Human hepatitis C virus
ggaggccgcaagccagccc

SEQ ID NO: 6627 - DNA, 19 bp, Human hepatitis C virus
acattctggcgggctatgg

SEQ ID NO: 6628 - DNA, 19 bp, Human hepatitis C virus
gtggccttcaaggtcatga

SEQ ID NO: 6629 - DNA, 19 bp, Human hepatitis C virus
gcccgaaccggacgtagca

SEQ ID NO: 6630 - DNA, 19 bp, Human hepatitis C virus
catgcctcaggaaacttgg

SEQ ID NO: 6631 - DNA, 19 bp, Human hepatitis C virus
ccagctgtctgcgccctcc

SEQ ID NO: 6632 - DNA, 19 bp, Human hepatitis C virus
acactccaggccaataggc

SEQ ID NO: 6633 - DNA, 19 bp, Human hepatitis C virus
ctccagttaactcctggct

SEQ ID NO: 6634 - DNA, 19 bp, Human hepatitis C virus
gctgcgccatcacaacatg

SEQ ID NO: 6635 - DNA, 19 bp, Human hepatitis C virus
gagccgcatgactgcagag

SEQ ID NO: 6636 - DNA, 19 bp, Human hepatitis C virus
aacatcttgggggggtggg

SEQ ID NO: 6637 - DNA, 19 bp, Human hepatitis C virus
ccaatcgatgaacggggag

SEQ ID NO: 6638 - DNA, 19 bp, Human hepatitis C virus
cggcgccaaactattccaa

SEQ ID NO: 6639 - DNA, 19 bp, Human hepatitis C virus
gcccgaaccggacgtagca

SEQ ID NO: 6640 - DNA, 19 bp, Human hepatitis C virus
gcgagcggcgtgctgacga

SEQ ID NO: 6641 - DNA, 19 bp, Human hepatitis C virus
gccacgacatcccgcagcg

SEQ ID NO: 6642 - DNA, 19 bp, Human hepatitis C virus
cctagactctttcgagccg

SEQ ID NO: 6643 - DNA, 19 bp, Human hepatitis C virus
cgcccaactcgctcccccc

SEQ ID NO: 6644 - DNA, 19 bp, Human hepatitis C virus
aagggaggccgcaagccag

SEQ ID NO: 6645 - DNA, 19 bp, Human hepatitis C virus
gaagggaggccgcaagcca

SEQ ID NO: 6646 - DNA, 19 bp, Human hepatitis C virus
agagcgtcgtctgctgctc

SEQ ID NO: 6647 - DNA, 19 bp, Human hepatitis C virus
gcccatctacacgctccca

SEQ ID NO: 6648 - DNA, 19 bp, Human hepatitis C virus
aagcaggcggaggctgccg

SEQ ID NO: 6649 - DNA, 19 bp, Human hepatitis C virus
cggccgccgacagcggcac

SEQ ID NO: 6650 - DNA, 19 bp, Human hepatitis C virus
ggcggggggacggcatcat

SEQ ID NO: 6651 - DNA, 19 bp, Human hepatitis C virus
ccgctccgtgtgggaggac

SEQ ID NO: 6652 - DNA, 19 bp, Human hepatitis C virus
gacatatatcacagcctgt

SEQ ID NO: 6653 - DNA, 19 bp, Human hepatitis C virus
ggaagaacccggactacgt

SEQ ID NO: 6654 - DNA, 19 bp, Human hepatitis C virus
ggaagaaagcaagctgccc

SEQ ID NO: 6655 - DNA, 19 bp, Human hepatitis C virus
ggaaacagctagacacact

SEQ ID NO: 6656 - DNA, 19 bp, Human hepatitis C virus
ctgggcgcgctgacgggca

SEQ ID NO: 6657 - DNA, 19 bp, Human hepatitis C virus
gtgagagcgtcgtctgctg

SEQ ID NO: 6658 - DNA, 19 bp, Human hepatitis C virus
acccttcctcaagccgtga

SEQ ID NO: 6659 - DNA, 19 bp, Human hepatitis C virus
cacccttcctcaagccgtg

SEQ ID NO: 6660 - DNA, 19 bp, Human hepatitis C virus
ctgttttgactcaacggtc

SEQ ID NO: 6661 - DNA, 19 bp, Human hepatitis C virus
ggggtgggtagccgcccaa

SEQ ID NO: 6662 - DNA, 19 bp, Human hepatitis C virus
gtgcttaaggagatgaagg

SEQ ID NO: 6663 - DNA, 19 bp, Human hepatitis C virus
gatgacccatttcttctcc

SEQ ID NO: 6664 - DNA, 19 bp, Human hepatitis C virus
tgatgacccatttcttctc

SEQ ID NO: 6665 - DNA, 19 bp, Human hepatitis C virus
gcggcgtgctgacgactag

SEQ ID NO: 6666 - DNA, 19 bp, Human hepatitis C virus
agcgacgggtcttggtcta

SEQ ID NO: 6667 - DNA, 19 bp, Human hepatitis C virus
gcaaagaatgaggttttct

SEQ ID NO: 6668 - DNA, 19 bp, Human hepatitis C virus
cgcacgatgcatctggcaa

SEQ ID NO: 6669 - DNA, 19 bp, Human hepatitis C virus
tctcgtgcccgaccccgct

SEQ ID NO: 6670 - DNA, 19 bp, Human hepatitis C virus
gcagtaaagaccaagctca

SEQ ID NO: 6671 - DNA, 19 bp, Human hepatitis C virus
acatggtctacgccacgac

SEQ ID NO: 6672 - DNA, 19 bp, Human hepatitis C virus
accatgtctcccccacgca

SEQ ID NO: 6673 - DNA, 19 bp, Human hepatitis C virus
caaagaatgaggttttctg

SEQ ID NO: 6674 - DNA, 19 bp, Human hepatitis C virus
ccggaacctatccagcagg

SEQ ID NO: 6675 - DNA, 19 bp, Human hepatitis C virus
catcgggccaggagcgtcc

SEQ ID NO: 6676 - DNA, 19 bp, Human hepatitis C virus
gcagaagaaggtcaccttt

SEQ ID NO: 6677 - DNA, 19 bp, Human hepatitis C virus
cttcatgcctcaggaaact

SEQ ID NO: 6678 - DNA, 19 bp, Human hepatitis C virus
tgtgaaaggtccgtgagcc

SEQ ID NO: 6679 - DNA, 19 bp, Human hepatitis C virus
gagcggagggggatgagaa

SEQ ID NO: 6680 - DNA, 19 bp, Human hepatitis C virus
cggggcgcgttccctgaca

SEQ ID NO: 6681 - DNA, 14121 bp, Homo sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaacaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctcaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctgaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtagtggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttgacccaccaatacaagttgaaggagactattcagaagctaagcaatgtcctacaacaagttaagataaaagattactttgagaaattggttggatttattgatgatgctgtgaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtcgaaatgaaagtaaagatcatcagaaccattgaccagatgcagaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattactcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacacttgcacaccgtgacttcagtgcagaatatgaagaagatggcaaatttgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaaaaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 6682 - DNA, 1790 bp, Homo sapiens
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccatccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaag

SEQ ID NO: 6683 - DNA, 3330 bp, Homo sapiens
tgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaaagtaagacacaaacaaaccatttttttctctttttttggagttgggggcccagggagaagggacaaggcttttaaaagacttgttagccaacttcaagaattaatatttatgtctctgttattgttagttttaagccttaaggtagaaggcacatagaaataacatc

SEQ ID NO: 6684 - DNA, 3880 bp, Homo sapiens
tgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatgctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaagaaaaagtaagacacaaacaaaccatttttttctctttttttggagttgggggcccagggagaagggacaaggcttttaaaagacttgttagccaacttcaagaattaatatttatgtctctgttattgttagttttaagccttaaggtagaaggcacatagaaataacatctcatctttctgctgaccattttagtgaggttgttccaaagagcattcaggtctctacctccagccctgcaaaaatattggacctagcacagaggaatcaggaaaattaatttcagaaactccatttgatttttcttttgctgtgtcttttttgagactgtaatatggtacactgtcctctaaggacatcctcattttatctcacctttttgggggtgagagctctagttcatttaactgtactctgcacaatagctaggatgactaagagaacattgcttcaagaaactggtggatttggatttccaaaatatgaaataaggagaaaaatgtttttatttgtatgaattaaaagatccatgttgaacatttgcaaatatttattaataaacagatgtggtgataaacccaaaacaaatgacaggtgcttattttccactaaacacagacacatgaaatgaaagtttagctagcccactatttgttgtaaattgaaaacgaagtgtgataaaataaatatgtagaaatcaaaaaaaaaaaaaaaaaaaa

SEQ ID NO: 6685 - DNA, 2560 bp, Homo sapiens
ggcacgaggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgagcaggtgccacgagcccgccgcctcttcgccgcccgccgcctctcctcctctcccgcccgccgcctggccctcccctaccaggctgagcctctggctgccagaagcgcggggcctccgggagaatacgtgcggtcgcccgctccgcgtgcgcctacgccttctgctccagttgctttcccaattgagcggaaaagccggggcatgttgccggggccctgggcgggacggttgtgccctgcagcccgaagcccgccggggcaccttcccgcccacgagctgcccagtccctctgcttgcggcccctgccaacgtcccacaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgtgtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaaaaaaaaaaaaaaaaaaaaaaaaaaaaaaaaaa

SEQ ID NO: 6686 - DNA, 3362 bp, Homo sapiens
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaaatttttttttttttttttttaagaatatctgtaatggtactgactttgcttgctttgaagtagctctttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcatt

SEQ ID NO: 6687 - DNA, 3318 bp, Homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 6688 - DNA, 9587 bp, Human hepatitis C virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggtaggacctgggctcagcccgggtacccttggcccctctatggcaacgagggtatggggtgggcaggatggctcctgtcaccccgtggctctcggcctagttggggccccacagacccccggcgtaggtcgcgtaatttgggtaaggtcatcgatacccttacatgcggcttcgccgacctcatggggtacattccgcttgtcggcgcccccctaggaggcgctgccagggccctggcgcatggcgtccgggttctggaggacggcgtgaactatgcaacagggaatctgcccggttgctctttctctatcttcctcttagctttgctgtcttgtttgaccatcccagcttccgcttacgaggtgcgcaacgtgtccgggatataccatgtcacgaacgactgctccaactcaagtattgtgtatgaggcagcggacatgatcatgcacacccccgggtgcgtgccctgcgtccgggagagtaatttctcccgttgctgggtagcgctcactcccacgctcgcggccaggaacagcagcatccccaccacgacaatacgacgccacgtcgatttgctcgttggggcggctgctctctgttccgctatgtacgttggggatctctgcggatccgtttttctcgtctcccagctgttcaccttctcacctcgccggtatgagacggtacaagattgcaattgctcaatctatcccggccacgtatcaggtcaccgcatggcttgggatatgatgatgaactggtcacctacaacggccctagtggtatcgcagctactccggatcccacaagccgtcgtggacatggtggcgggggcccactggggtgtcctagcgggccttgcctactattccatggtggggaactgggctaaggtcttgattgtgatgctactctttgctggcgttgacgggcacacccacgtgacagggggaagggtagcctccagcacccagagcctcgtgtcctggctctcacaagggccatctcagaaaatccaactcgtgaacaccaacggcagctggcacatcaacaggaccgctctgaattgcaatgactccctccaaactgggttcattgctgcgctgttctacgcacacaggttcaacgcgtccggatgtccagagcgcatggccagctgccgccccatcgacaagttcgctcaggggtggggtcccatcactcacgttgtgcctaacatctcggaccagaggccttattgctggcactatgcaccccaaccgtgcggtattgtacccgcgtcgcaggtgtgtggcccagtgtattgcttcaccccgagtcctgttgtggtggggacgaccgaccgttccggagtccccacgtatagctggggggagaatgagacagacgtgctgctactcaacaacacgcggccgccgcaaggcaactggttcggctgtacatggatgaatagcaccgggttcaccaagacgtgcgggggccccccgtgtaacatcgggggggttggcaacaacaccttgatttgccccacggattgcttccgaaagcaccccgaggccacttacaccaaatgcggctcgggtccttggttgacacctaggtgtctagttgactacccatacagactttggcactacccctgcactatcaattttaccatcttcaaggtcaggatgtacgtggggggcgtggagcacaggctcaacgccgcgtgcaattggacccgaggagagcgctgtgacctggaggacagggatagatcagagcttagcccgctgctattgtctacaacggagtggcaggtactgccctgttcctttaccaccctaccggctctgtccactggattgatccacctccatcagaatatcgtggacgtgcaatacctgtacggtgtagggtcagtggttgtctccgtcgtaatcaaatgggagtatgttctgctgctcttccttctcctggcggacgcgcgcgtctgtgcctgcttgtggatgatgctgctgatagcccaggctgaggccaccttagagaacctggtggtcctcaatgcggcgtctgtggccggagcgcatggccttctctccttcctcgtgttcttctgcgccgcctggtacatcaaaggcaggctggtccctggggcggcatatgctctctatggcgtatggccgttgctcctgctcttgctggctttaccaccacgagcttatgccatggaccgagagatggctgcatcgtgcggaggcgcggtttttgtaggtctggtactcttgaccttgtcaccatactataaggtgttcctcgctaggctcatatggtggttacaatattttatcaccagggccgaggcgcacttgcaagtgtgggtcccccctcttaatgttcggggaggccgcgatgccatcatcctccttacatgcgcggtccatccagagctaatctttgacatcaccaaactcctgctcgccatactcggtccgctcatggtgctccaagctggcataaccagagtgccgtacttcgtgcgcgctcaagggctcattcatgcatgcatgttagtgcggaaggtcgctgggggtcattatgtccaaatggccttcatgaagctgggcgcgctgacaggcacgtacatttacaaccatcttaccccgctacgggattgggcccacgcgggcctacgagaccttgcggtggcagtggagcccgtcgtcttctccgacatggagaccaagatcatcacctggggagcagacaccgcggcgtgtggggacatcatcttgggtctgcccgtctccgcccgaaggggaaaggagatactcctgggcccggccgatagtcttgaagggcgggggtggcgactcctcgcgcccatcacggcctactcccaacagacgcggggcctacttggttgcatcatcactagccttacaggccgggacaagaaccaggtcgagggagaggttcaggtggtttccaccgcaacacaatccttcctggcgacctgcgtcaacggcgtgtgttggaccgtttaccatggtgctggctcaaagaccttagccggcccaaaggggccaatcacccagatgtacactaatgtggaccaggacctcgtcggctggcaggcgccccccggggcgcgttccttgacaccatgcacctgtggcagctcagacctttacttggtcacgagacatgctgacgtcattccggtgcgccggcggggcgacagtagggggagcctgctctcccccaggcctgtctcctacttgaagggctcttcgggtggtccactgctctgcccttcggggcacgctgtgggcatcttccgggctgccgtatgcacccggggggttgcgaaggcggtggactttgtgcccgtagagtccatggaaactactatgcggtctccggtcttcacggacaactcatcccccccggccgtaccgcagtcatttcaagtggcccacctacacgctcccactggcagcggcaagagtactaaagtgccggctgcatatgcagcccaagggtacaaggtgctcgtcctcaatccgtccgttgccgctaccttagggtttggggcgtatatgtctaaggcacacggtattgaccccaacatcagaactggggtaaggaccattaccacaggcgcccccgtcacatactctacctatggcaagtttcttgccgatggtggttgctctgggggcgcttatgacatcataatatgtgatgagtgccattcaactgactcgactacaatcttgggcatcggcacagtcctggaccaagcggagacggctggagcgcggcttgtcgtgctcgccaccgctacgcctccgggatcggtcaccgtgccacacccaaacatcgaggaggtggccctgtctaatactggagagatccccttctatggcaaagccatccccattgaagccatcagggggggaaggcatctcattttctgtcattccaagaagaagtgcgacgagctcgccgcaaagctgtcaggcctcggaatcaacgctgtggcgtattaccgggggctcgatgtgtccgtcataccaactatcggagacgtcgttgtcgtggcaacagacgctctgatgacgggctatacgggcgactttgactcagtgatcgactgtaacacatgtgtcacccagacagtcgacttcagcttggatcccaccttcaccattgagacgacgaccgtgcctcaagacgcagtgtcgcgctcgcagcggcggggtaggactggcaggggtaggagaggcatctacaggtttgtgactccgggagaacggccctcgggcatgttcgattcctcggtcctgtgtgagtgctatgacgcgggctgtgcttggtacgagctcacccccgccgagacctcggttaggttgcgggcctacctgaacacaccagggttgcccgtttgccaggaccacctggagttctgggagagtgtcttcacaggcctcacccacatagatgcacacttcttgtcccagaccaagcaggcaggagacaacttcccctacctggtagcataccaagccacggtgtgcgccagggctcaggccccacctccatcatgggatcaaatgtggaagtgtctcatacggctgaaacctacgctgcacgggccaacacccttgctgtacaggctgggagccgtccaaaatgaggtcaccctcacccaccccataaccaaatacatcatggcatgcatgtcggctgacctggaggtcgtcactagcacctgggtgctggtgggcggagtccttgcagctctggccgcgtattgcctgacaacaggcagtgtggtcattgtgggtaggattatcttgtccgggaggccggctattgttcccgacagggagcttctctaccaggagttcgatgaaatggaagagtgcgccacgcacctcccttacattgagcagggaatgcagctcgccgagcagttcaagcagaaagcgctcgggttactgcaaacagccaccaaacaagcggaggctgctgctcccgtggtggagtccaagtggcgagcccttgagacattctgggcgaagcacatgtggaatttcatcagcgggatacagtacttagcaggcttatccactctgcctgggaaccccgcaatagcatcattgatggcattcacagcctctatcaccagcccgctcaccacccaaagtaccctcctgtttaacatcttgggggggtgggtggctgcccaactcgccccccccagcgccgcttcggctttcgtgggcgccggcatcgccggtgcggctgttggcagcataggccttgggaaggtgcttgtggacattctggcgggttatggagcaggagtggccggcgcgctcgtggcctttaaggtcatgagcggcgagatgccctctaccgaggacctggtcaatctacttcctgccatcctctctcctggcgccctggtcgtcggggtcgtgtgtgcagcaatactgcgtcggcacgtgggtccgggagagggggctgtgcagtggatgaaccggctgatagcgttcgcctcgcggggtaatcacgtttcccccacgcactatgtgcctgagagcgacgccgcagcgcgtgttactcagatcctctccagccttaccatcactcagctgctgaaaaggctccaccagtggattaatgaggactgctccacaccgtgttccggctcgtggctaagggatgtttgggactggatatgcacggtgttgactgacttcaagacctggctccagtccaagctcctgccgcagctaccgggagtcccttttttctcgtgccaacgcgggtacaagggagtctggcggggagacggcatcatgcaaaccacctgcccatgtggagcacagatcaccggacatgtcaaaaacggttccatgaggatcgtcgggcctaagacctgcagcaacacgtggcatggaacattccccatcaacgcatacaccacgggcccctgcacaccctctccagcgccaaactattctagggcgctgtggcgggtggccgctgaggagtacgtggaggtcacgcgggtgggggatttccactacgtgacgggcatgaccactgacaacgtaaagtgcccatgccaggttccggctcctgaattcttctcggaggtggacggagtgcggttgcacaggtacgctccggcgtgcaggcctctcctacgggaggaggttacattccaggtcgggctcaaccaatacctggttgggtcacagctaccatgcgagcccgaaccggatgtagcagtgctcacttccatgctcaccgacccctcccacatcacagcagaaacggctaagcgtaggttggccagggggtctcccccctccttggccagctcttcagctagccagttgtctgcgccttccttgaaggcgacatgcactacccaccatgtctctccggacgctgacctcatcgaggccaacctcctgtggcggcaggagatgggcgggaacatcacccgcgtggagtcggagaacaaggtggtagtcctggactctttcgacccgcttcgagcggaggaggatgagagggaagtatccgttccggcggagatcctgcggaaatccaagaagttccccgcagcgatgcccatctgggcgcgcccggattacaaccctccactgttagagtcctggaaggacccggactacgtccctccggtggtgcacgggtgcccgttgccacctatcaaggcccctccaataccacctccacggagaaagaggacggttgtcctaacagagtcctccgtgtcttctgccttagcggagctcgctactaagaccttcggcagctccgaatcatcggccgtcgacagcggcacggcgaccgcccttcctgaccaggcctccgacgacggtgacaaaggatccgacgttgagtcgtactcctccatgcccccccttgagggggaaccgggggaccccgatctcagtgacgggtcttggtctaccgtgagcgaggaagctagtgaggatgtcgtctgctgctcaatgtcctacacatggacaggcgccttgatcacgccatgcgctgcggaggaaagcaagctgcccatcaacgcgttgagcaactctttgctgcgccaccataacatggtttatgccacaacatctcgcagcgcaggcctgcggcagaagaaggtcacctttgacagactgcaagtcctggacgaccactaccgggacgtgctcaaggagatgaaggcgaaggcgtccacagttaaggctaaactcctatccgtagaggaagcctgcaagctgacgcccccacattcggccaaatccaagtttggctatggggcaaaggacgtccggaacctatccagcaaggccgttaaccacatccactccgtgtggaaggacttgctggaagacactgtgacaccaattgacaccaccatcatggcaaaaaatgaggttttctgtgtccaaccagagaaaggaggccgtaagccagcccgccttatcgtattcccagatctgggagtccgtgtatgcgagaagatggccctctatgatgtggtctccacccttcctcaggtcgtgatgggctcctcatacggattccagtactctcctgggcagcgagtcgagttcctggtgaatacctggaaatcaaagaaaaaccccatgggcttttcatatgacactcgctgtttcgactcaacggtcaccgagaacgacatccgtgttgaggagtcaatttaccaatgttgtgacttggcccccgaagccagacaggccataaaatcgctcacagagcggctttatatcgggggtcctctgactaattcaaaagggcagaactgcggttatcgccggtgccgcgcgagcggcgtgctgacgactagctgcggtaacaccctcacatgttacttgaaggcctctgcagcctgtcgagctgcgaagctccaggactgcacgatgctcgtgaacggagacgaccttgtcgttatctgtgaaagcgcgggaacccaagaggacgcggcgagcctacgagtcttcacggaggctatgactaggtactctgccccccccggggacccgccccaaccagaatacgacttggagctgataacatcatgttcctccaatgtgtcggtcgcccacgatgcatcaggcaaaagggtgtactacctcacccgtgatcccaccacccccctcgcacgggctgcgtgggaaacagctagacacactccagttaactcctggctaggcaacattatcatgtatgcgcccactttgtgggcaaggatgattctgatgactcacttcttctccatccttctagcacaggagcaacttgaaaaagccctggactgccagatctacggggcctgttactccattgagccacttgacctacctcagatcattgaacgactccatggccttagcgcattttcactccatagttactctccaggtgagatcaatagggtggcttcatgcctcaggaaacttggggtaccacccttgcgagtctggagacatcgggccaggagcgtccgcgctaggctactgtcccagggggggagggccgccacttgtggcaagtacctcttcaactgggcagtgaagaccaaactcaaactcactccaatcccggctgcgtcccagctggacttgtccggctggttcgttgctggttacagcgggggagacatatatcacagcctgtctcgtgcccgaccccgctggttcatgctgtgcctactcctactttctgtaggggtaggcatctacctgctccccaaccgatgaacggggagctaaacactccaggccaataggccatttcctgttttttttttttttttttttttttttttttttttcttttccttctttttccctttttctttcttccttctttaatggtggctccatcttagccctagtcacggctagctgtgaaaggtccgtgagccgcatgactgcagagagtgctgatactggcctctctgcagatcatgt

SEQ ID NO: 6689 - DNA, 9414 bp, Human hepatitis C virus
tgccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggatattaagttcccgggcggtggtcagatcgttggtggagtttacttgttgccgcgcaggggccccaggttgggtgtgcgcgcgactaggaagacttccgagcggtcgcaacctcgtggaaggcgacagcctatccccaaggctcgccggcccgagggcagggcctgggctcagcccgggtacccttggcccctctatggcaatgagggcttggggtgggcaggatggctcctgtcaccccgcggctcccggcctagttggggccccacggacccccggcgtaagtcgcgtaatttgggtaaggtcatcgacaccctcacatgcggcttcgccgacctcatggggtacattccgctcgtcggcgcccccctagggggcgttgccagggccctggcacatggtgtccgggtgctggaggacggcgtgaactatgcaacagggaatctgcccggttgctctttctctatcttcctcttggctctgctgtcttgtttgaccaccccagtttccgcttatgaagtgcgtaacgcgtccgggatgtaccatgtcacgaacgactgctccaactcaagcattgtgtatgaggcagcggacatgatcatgcacactcccgggtgcgtgccctgcgttcgggaggacaactcctcccgttgctgggtggcacttactcccacgctcgcggccaggaatgccagcgtccccactacgacattgcgacgccatgtcgacttgctcgttggggtagctgctttctgttccgctatgtacgtgggggacctctgcggatctgttttccttgtttcccagctgttcaccttttcgcctcgccggcatgagacggtacaggactgcaactgctcaatctatcccggccgcgtatcaggtcaccgcatggcctgggatatgatgatgaactggtcgcctacaacagccctagtggtatcgcagctactccggatcccacaagctgtcgtggacatggtgacagggtcccactggggaatcctggcgggccttgcctactattccatggtggggaactgggctaaggtcttaattgcgatgctactctttgccggcgttgacggaaccacccacgtgacagggggggcgcaaggtcgggccgctagctcgctaacgtccctctttagccctgggccggttcagcacctccagctcataaacaccaacggcagctggcatatcaacaggaccgccctgagctgcaatgactccctcaacactgggtttgttgccgcgctgttctacaaatacaggttcaacgcgtccgggtgcccggagcgcttggccacgtgccgccccattgatacattcgcgcaggggtggggtcccatcacttacactgagcctcatgatttggatcagaggccctattgctggcactacgcgcctcaaccgtgtggtattgtgcccacgttgcaggtgtgtggcccagtatactgcttcaccccgagtcctgttgcggtggggactaccgatcgtttcggtgcccctacatacagatggggggcaaatgagacggacgtgctgctccttaacaacgccgggccgccgcaaggcaactggttcggctgtacatggatgaatggcactgggttcaccaagacatgtgggggccccccgtgtaacatcgggggggtcggcaacaataccttgacctgccccacggactgcttccgaaagcaccccggggccacttacaccaaatgcggttcggggccttggttaacacccaggtgcttagtcgactacccgtacaggctctggcattacccctgcactgtcaactttaccatctttaaggttaggatgtacgtggggggcgcggagcacaggctcgacgccgcatgcaactggactcggggagagcgttgtgacctggaggacagggataggtcagagcttagcccgctgctgctgtctacaacagagtggcaggtactgccctgttccttcacaaccctaccggctctgtccactggtttgattcatctccatcagaacatcgtggacatacaatacctgtacggtatagggtcggcggttgtctcctttgcgatcaaatgggagtatattgtgctgctcttccttcttctggcggacgcgcgcgtctgcgcttgcttgtggatgatgctgctggtagcgcaagccgaggccgccttagagaacctggtggtcctcaatgcagcgtccgtggccggagcgcatggcattctttccttcattgtgttcttctgtgctgcctggtacatcaagggcaggctggttcccggagcggcatacgccctctatggcgtatggccgctgcttctgcttctgctggcgttaccaccacgggcgtacgccatggaccgggagatggccgcatcgtgcggaggcgcggtttttgtaggtctggtactcttgaccttgtcaccacactataaagtgttccttgccaggttcatatggtggctacaatatctcatcaccagaaccgaagcgcatctgcaagtgtgggtcccccctctcaacgttcgggggggtcgcgatgccatcatcctcctcacatgcgtggtccacccagagctaatctttgacatcacaaaatatttgctcgccatattcggcccgctcatggtgctccaggccggcataactagagtgccgtacttcgtgcgcgcacaagggctcattcgtgcatgcatgttggcgcggaaagtcgtggggggtcattacgtccaaatggtcttcatgaagctggccgcactagcaggtacgtacgtttatgaccatcttactccactgcgagattgggctcacacgggcttacgagaccttgcagtggcagtagagcccgttgtcttctctgacatggagaccaaagtcatcacctggggggcagacaccgcggcgtgcggggacatcatcttggccctgcctgcttccgcccgaagggggaaggagatacttctgggaccggccgatagtcttgaaggacaggggtggcgactccttgcgcccatcacggcctactcccaacaaacgcgaggcctgcttggttgcatcatcactagccttacaggccgggacaagaaccaggttgagggggaggttcaagtggtttccaccgcaacacaatctttcctggcgacctgcatcaatggcgtgtgttggactgtcttccacggcgccggctcaaagaccctagccggcccaaagggtccaatcacccaaatgtacaccaatgtagaccaggaccttgttggctggccggcacctcctggggcgcgttccctgacaccatgcacttgcggctcctcggacctttacctggtcacgagacatgctgatgtcattccggtgcgccggcggggtgacggtagggggagcctactcccccccaggcctgtctcctacttgaagggctcctcgggtggtccactgctctgcccttcggggcacgctgtcggcatacttccggctgctgtatgcacccggggggttgccatggcggtggaattcatacccgttgagtctatggaaactactatgcggtctccggtcttcacggacaatccgtctcccccggctgtaccgcagacattccaagtggcccacttacacgctcccaccggcagcggcaagagcactagggtgccggctgcatatgcagcccaagggtacaaggtgctcgtcctaaatccgtccgtcgccgccaccttgggttttggggcgtatatgtccaaggcacatggtatcgaccccaaccttagaactggggtaaggaccatcaccacaggtgcccctatcacatactccacctatggcaagttccttgccgacggtggcggctccgggggcgcctatgacatcataatgtgtgatgagtgccactcaactgactcgactaccatttatggcatcggcacagtcctggaccaagcggagacggctggagcgcggctcgtggtgctctccaccgctacgcctccgggatcggtcaccgtgccacacctcaatatcgaggaggtggccctgtctaatactggagagatccccttctacggcaaagccattcccatcgaggctatcaaggggggaaggcatctcattttctgccattccaagaagaagtgtgacgaactcgccgcaaagctgtcaggcctcggactcaatgccgtagcgtattaccggggtcttgacgtgtccgtcataccgaccagcggagacgttgttgtcgtggcgacggacgctctaatgacgggctttaccggcgactttgactcagtgatcgactgtaatacgtgtgtcacccagacagtcgatttcagcttggaccccaccttcaccattgagacgacgaccgtgccccaagacgcagtgtcgcgctcgcagaggcgaggcaggactggtaggggcagggctggcatatacaggtttgtgactccaggagaacggccctcgggcatgttcgattcttcggtcctgtgtgagtgttatgacgcgggttgtgcgtggtacgaactcacgcccgctgagacctcggttaggttgcgggcgtacctaaacacaccagggttgcccgtctgccaggaccatctggagttctcggagggtgtcttcacaggcctcacccacatagatgcccacttcttatcccagactaaacaggcaggagagaacttcccctacttggtagcataccaggctacagtgtgcgccagggctcaagccccacctccatcgtgggatgaaatgtggaggtgtctcatacggctgaaacctacgctgcacgggccaacacccctgctgtataggttaggagccgtccaaaatgaggtcaccctcacacaccccataaccaaattcatcatgacatgtatgtcggctgacctggaggtcgtcaccagcacctgggtgctggtaggcggagtcctcgcagctctggccgcgtactgcctgacaacaggcagcgtggtcattgtgggcaggatcatcctgtccgggaagccggctatcatccccgatagggaagttctctaccaggagttcgacgagatggaggagtgtgcctcacacctcccttacttcgaacagggaatgcagctcgccgagcaattcaaacagaaggcgctcgggttgctgcaaacagccaccaagcaggcggaggctgctgctcccgtggtggagtccaagtggcgagcccttgagaccttctgggcgaagcacatgtggaacttcattagtgggatacagtacttggcaggcttgtccactctgcctgggaaccccgcaatacgatcaccgatggcattcacagcctccatcaccagcccgctcaccacccagcataccctcttgtttaacatcttggggggatgggtggctgcccaactcgccccccccagcgctgcctcagctttcgtgggcgccggcatcgctggagccgctgttggcacgataggccttgggaaggtgcttgtggacattctggcaggttatggagcaggggtggcgggcgcacttgtggcctttaagatcatgagcggcgagatgccttcagccgaggacatggtcaacttactccctgccatcctttctcccggtgccctggtcgtcgggattgtgtgtgcagcaatactgcgtcggcatgtgggcccaggggaaggggctgtgcagtggatgaaccggctgatagcgttcgcctcgcggggtaaccacgtctcccccaggcactatgtgccagagagcgagcctgcagcgcgtgttacccagatcctttccagcctcaccatcactcagctgttgaagagactccaccagtggattaatgaggactgctctacgccatgctccagctcgtggctaagggagatttgggactggatctgcacggtgttgactgacttcaagacctggctccagtccaagctcctgccgcgattaccgggagtcccttttttctcatgccaacgcgggtataagggagtctggcggggggacggcatcatgcacaccacctgcccatgcggagcacagatcaccggacacgtcaaaaacggttccatgaggatcgttgggcctaaaacctgcagcaacacgtggtacgggacattccccatcaacgcgtacaccacgggcccctgcacaccctccccggcgccaaactattccaaggcattgtggagagtggccgctgaggagtacgtggaggtcacgcgggtgggagattttcactacgtgacgggcatgaccactgacaacgtgaagtgtccatgccaggttccggcccccgaattcttcacggaggtggatggagtgcggttgcacaggtacgctccggcgtgcagacctctcctacgggaggaggtcgtattccaggtcgggctccaccagtacctggtcgggtcacagctcccatgcgagcccgaaccggatgtagcagtgctcacttccatgctcactgacccctcccacattacagcagagacggctaagcgtaggctggccagggggtctcccccctccttggccagctcttcagctagccagttgtctgcgccttccttgaaggcgacatgcactacccatcatgactccccggacgctgacctcattgaggccaacctcttgtggcggcaagagatgggcgggaacatcacccgcgtggagtcagagaataaggtggtaatcctggactctttcgacccgctccgagcggaggatgatgagggggaaatatccgttccggcggagatcctgcggaaatccaggaaattccccccagcgctgcccatatgggcgccgccggattacaaccctccgctgctagagtcctggaaggacccggactacgttcctccggtggtacacgggtgcccgttgccgcccaccaaggcccctccaataccacctccacggaggaagaggacggttgtcctgacagaatccaccgtgtcttctgccttggcggagctcgctactaagaccttcggcagctccggatcgtcggccatcgacagcggtacggcgaccgcccctcctgaccaagcctccggtgacggcgacagagagtccgacgttgagtcgttctcctccatgcccccccttgagggagagccgggggaccccgatctcagcgacggatcttggtccaccgtgagcgaggaggctagtgaggacgtcgtctgctgttcgatgtcctacacatggacaggcgccctgatcacgccatgcgctgcggaggaaagcaagttgcccatcaacccgttgagcaattctttgctacgtcaccacaacatggtctatgctacaacatcccgcagcgcaggcctgcggcagaagaaggtcacctttgacagactgcaagtcctggacgaccactaccgggacgtgcttaaggagatgaaggcgaaggcgtccacagttaaggctaaacttctatctgtagaagaagcctgcaaactgacgcccccacattcggccaaatccaaatttggctacggggcgaaggacgtccggagcctatccagcagggccgttacccacatccgctccgtgtggaaggacctgctggaagacactgaaacaccaattagcactaccatcatggcaaaaaatgaggttttctgtgtccaaccagagaagggaggccgcaagccagctcgccttatcgtgttcccagatctgggagttcgtgtatgcgagaagatggccctttatgacgtggtctccacccttcctcaggccgtgatgggctcctcatacggattccagtactctcctaagcagcgggtcgagttcctggtgaatacctggaaatcaaagaaatgccccatgggcttctcatatgacacccgctgttttgactcaacggtcactgagaatgacatccgtgttgaggagtcaatttaccaatgttgtgacttggcccccgaagccaaactggccataaagtcgctcacagagcggctctatatcgggggtcccctgactaattcaaaagggcagaactgcggttaccgccggtgccgcgcgagcggcgtgctgacgactagctgcggtaataccctcacatgttacctgaaagccactgcggcctgtcgagctgcgaagctccgggactgcacgatgctcgtgaacggagacgaccttgtcgttatctgtgaaagcgcgggaacccaagaggatgcggcgagcctacgagtcttcacggaggctatgactaggtactctgccccccctggggacccgcctcaaccggaatacgacttggagttgataacatcatgttcctccaatgtgtcggtcgcacacgatgcatctggtaaaagggtgtactacctcacccgtgaccctaccaccccccttgcacgggctgcgtgggagacagctagacacactccagtcaactcctggctaggcaacatcatcatgtatgcgcccaccttatgggcaaggatgattctgatgactcatttcttctccatccttctagctcaggagcaacttgaaaaaaccctagattgtcagatctacggggcctgttactccattgaaccacttgatctacctcagatcattgagcgactccatggtcttagcgcattttcactccatagttactctccaggcgagatcaatagggtggcttcatgcctcagaaaacttggggtaccacccttgcgagcctggagacatcgggccagaagtgtccgcgctaagctactgtcccagggggggagggccgccacttgtggcaagtacctcttcaactgggcggtgaggaccaagctcaaactcactccaatcccagccgcgtcccggttggacttgtccggctggttcgttgctggttacagcgggggagacatatatcacagcctgtctcgtgcccgaccccgctggttcatgttgtgcctactcctactttccgtgggggtaggcatctacctgctccccaaccgatgaatggggagctaaacactccaggccaataggccgtttctc

SEQ ID NO: 6690 - DNA, 9400 bp, Human hepatitis C virus
attgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccgacccgagggcaggacctgggctcagcccgggtatccttggcccctctatggcaatgagggctttgggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccttggggggcgctgccagggccctggcacatggtgtccgggttctggaggacggcgtgaactatgcaacagggaatttgcccggttgctctttctctatcttccttttagccttgctatcctgtttgaccaccccagcttccgcttacgaagtgcgtaacgtgtccgggatataccatgtcacgaacgactgctccaactcaagcattgtgtatgaggcagcggacctgatcatgcatacccctgggtgcgtgccctgcgttcgggaaggcaactcctcccgttgctgggtagcgctcactcccacgctcgcggccaggaacgccacgatccccactgcgacagtacgacggcatgtcgatctgctcgttggggcggctgctttctcttccgccatgtacgtgggggatctctgcggatctgttttccttgtctctcagctgttcaccttctcgcctcgccggtatgagacaatacaggactgcaattgctcaatctatcccggccacgtaacaggtcaccgcatggcttgggatatgatgatgaactggtcgcctacaacagctctagtggtgtcgcagttactccggatccctcaagccgtcatggacatggtggtgggggcccactggggagtcctggcgggccttgcctactatgccatggtggggaattgggctaaggttttgattgtgatgctactcttcgccggcgttgatggggatacctacgcgtctgggggggcgcagggccgctccaccctcgggttcacgtccctctttacacctggggcctctcagaagatccagcttataaataccaatggtagctggcatatcaacaggactgccctgaactgcaatgactccctcaatactgggtttcttgccgcgctgttctatacacacaggttcaacgcgtccggatgcgcagagcgcatggccagctgccgccccattgatacattcgatcagggctggggccccatcacttatactgagcctgatagctcggaccagaggccttattgctggcactacgcgcctcgaaagtgcggcatcgtacctgcgtcggaggtgtgcggtccagtgtattgtttcaccccaagccctgtcgtcgtggggacgaccgatcgtttcggtgtccccacatatagctggggggagaatgagacagacgtgctgctcctcaacaacacgcggccgccgcaaggcaactggtttggctgtacatggatgaatggcactgggttcaccaagacgtgcggggggcctccgtgtaacatcgggggggtcggcaacaacactttgacttgccccacggattgctttcggaagcaccccgaggctacgtatacaaggtgtggttcggggccttggctgacacctaggtgcttagttgactacccatacaggctctggcactacccctgcactgtcaactttgccatcttcaaagttaggatgtatgtggggggcgtggagcacaggctcgatgctgcatgcaactggactcgaggagagcgctgtaacttggaggacagggatagatcagaactcagcccgctgctactgtctacaacagagtggcagatactaccctgcgccttcaccaccctaccggctctgtccactggtttaatccatctccatcagaacatcgtggacgtgcaatacctgtacggtatagggtcagcggttgcctcctttgcaattaaatgggagtatgtcttgttgcttttccttctactagcagacgcgcgcgtatgtgcctgcttgtggatgatgctgctgatagcccaggccgaggccgccttagagaacctggtggtcctcaatgcggcgtccgtggccgacgcgcatggcatcctctccttccttgtgttcttttgtgccgcctggtacattaagggcaggctggtccccggggcagcatacgctttctacggcgtgtggccgctgctcctgctcctgctgacattaccaccacgagcttacgccatggaccgggagatggctgcatcgtgcggaggcgcggtttttgtaggtctggtattcctgactttgtcaccatactacaaggtgttcctcgctaggctcatatggtggttgcaatacttcctcaccatagccgaggcgcacctgcaagtgtggatcccccctctcaacattcgagggggccgcgatgccatcatcctcctcacgtgtgcaatccacccagagtcaatctttgacatcaccaaactcctgctcgccacgctcggtccgctcctggtgcttcaggctggcataactagagtgccgtactttgtgcgcgctcatgggctcattcgcgcgtgcatgctattgcggaaagttgctgggggtcattatgtccaaatggccttcatgaagctgggcgcactgacaggtacgtacgtctataaccatcttactccgctgcagtattggccacgcgcgggtttacgagaactcgcggtggcagtagagcccgtcatcttctctgacatggagaccaagattatcacctggggggcagacactgcagcgtgtggagacatcatcttgggtttacccgtctccgcccgaaggggaaaggagatactcctggggccggccgatagtcttgaagggcaggggtggcgactccttgcgcccatcacggcctactcccaacagacgcggggcttacttggttgcatcatcactagcctcacaggccgagacaagaaccaggtcgagggggaggttcaagtggtctccaccgcaacacaatctttcctggcgacctgcatcaacggtgtgtgttggactgtctatcatggcgccggctcaaaaaccttagccggcccaaagggcccaatcacccaaatgtacaccaatgtagaccaggacctcgtcggctggcaccggccccccggggcgcgttccctaacaccatgcacctgcggcagctcggacctttacttggtcacgagacatgctgatgtcattccggtgcgccgtcgaggcgacagtagggggagtttactctcccccaggcctgtctcctacctgaagggctcgtcggggggcccactgctctgccccttcgggcacgttgcaggcatcttccgggctgctgtgtgcacccggggggttgcgaaggcggtggattttatacccgttgagaccatggaaactaccatgcggtccccggtcttcacggacaactcatcccctcctgccgtaccgcagacattccaagtggcccatctacacgctcccactggcagcggcaaaagcaccaaggtgccggctgcatatgcagcccaagggtacaaggtacttgtcttgaacccgtctgttgccgccactttaggttttggggcgtatatgtctaaggcacatggtgtcgaccccaacattagaaccggggtaaggaccatcaccacgggcgcccccatcacatactctacctatggcaagttccttgctgatggtggttgctctgggggtgcctatgacattataatatgtgatgagtgccattcaactgactcgactaccatcttgggcatcggcacggtcctggaccaagcggagacggctggagcgcggcttgtcgtgctcgccaccgctacgcctccgggatcggtcaccgtgccacatccaaacatcgaggaggtggccctgtccaatactggagagatccccttctatggtaaagccatccccatcgaagccatcagggggggaaggcatctcattttctgccactccaagaagaagtgtgacgagcttgctgcaaagctatcatcgctcgggctcaacgctgtggcgtactaccgggggcttgatgtgtccgtcataccatctagcggagacgtcgttgtcgtggcaacggacgctctaatgacgggctttacgggcgactttgactcagtgatcgactgtaacacatgtgttacccaaacagtcgatttcagcttggaccccaccttcaccatcgagacaacgaccgtgccccaagacgcggtgtcgcgctcgcagcggcgaggtaggactggcaggggtagggaaggcatctacaggtttgttactccaggagaacggccctcgggcatgttcgactcctcagtcctgtgtgagtgctatgacgcgggctgtgcttggtacgagctcacgccggctgagaccacggttaggttgcgggcttacctaaatacaccagggttgcccgtctgccaggaccatctggagttctgggagggcgtcttcacaggtctcacccatatagacgctcactttctgtcccagaccaagcaagcaggagacaacttcccctacctggtagcataccaagctacagtgtgtgccaaggctcaggccccacctccatcgtgggatcaaatgtggaagtgcctcacacggctaaagcctacgctgcagggaccaacacccctgctgtataggctaggagccgtccaaaatgaggtcaccctcacacaccccataactaaatacatcatgacatgcatgtcggctgacctggaggtcgtcaccagcacctgggtgctggtgggcggagtccttgcagctctggccgcgtattgcctgacaacgggcagcgtggtcattgtgggtaggattgtcttgtccggaagtccggctattgttcctgacagggaagttctttaccaagacttcgacgagatggaagagtgtgcctcacacctcccttacatcgaacagggaatgcagctcgccgagcagttcaagcagaaggcgctcgggttgctgcaaacagccaccaagcaagcggaggctgctgctcccgtggtggagtccaagtggcgagccctcgagacattttgggaaaaacacatgtggaatttcatcagcgggatacagtacttagcaggcttatccactctgcctgggaaccccgcaatggcatcactgatggcattcacagcttctatcaccagcccgctcactacccaacacaccctcctgtttaacatcttgggtggatgggtggctgcccaactcgctccccccagcgccgcttcggcctttgtgggcgccggcattgccggtgcggctgttggcagcataggccttgggaaggtgcttgtggacatcctggcgggttatggggcgggggtggctggcgcactcgtggcctttaaggtcatgagtggcgaaatgccctccactgaggacctggttaatttactccctgccatcctctctcctggtgccctagtcgtcggggtcgtgtgcgcagcaatactgcgccgacacgtgggcccgggagagggggctgtgcagtggatgaaccggctgatagcgttcgcttcgcggggtaaccatgtctcccccacgcactatgtgcctgaaagtgacgccgcagcgcgtgttacccagatcctctccagccttaccatcactcagctgctgaaaagacttcaccagtggattaatgaggactgttccacaccatgctccggctcgtggctaagggatgtttgggattggatatgcacggtgttgaccgatttcaagacctggctccagtccaagctcctgccgcggttgcccggagtccctttcctctcatgccaacgcgggtacaagggagtctggcggggggacggtattatgcaaaccacctgtccatgtggagcacagattactggacatgtcaaaaacggttccatgagaatcgttgggcctaagacttgtagcaacacgtggcatggaacattccccatcaacgcgtacaccacgggcccctgcacaccctccccggcgccgaactattccagggcgctgtggcgggtggctcctgaggagtacgtggaggttacgcgggtgggggatttccactacgtgacgggcatgaccaccgacaacgtgaaatgcccatgccaagtcccggcccctgaattcttcacggaggtggatggagtacggctgcacaggtacgctccggcgtgcaaacctctcctacgggaggaggtcgtgttccaggtcgggctcaaccaatacctggttggatcacagctcccatgcgagcccgagccggacgtaacagtgctcacttccatgcttaccgacccctcccacatcacagcagagacggccaagcgtaggctggccagggggtctcccccctccttggccagctcttcagctagccaattgtctgcgccttctttgaaggcgacatgtactacccatcatgactccccggacgccgacctcattgaggccaacctcctgtggcggcaggagatgggcggaaacatcacccgtgtggagtcagaaaataaggtagtgatcctggactctttcgacccgcttcgggcggaggaggacgagagggaagtatccgttgcggcggagatcctgcggaaatccaggaagttcccctcagcgctgcccatatgggcacgcccagactacaaccctccactgctagagtcctggaaggacccagattatgtccctccggtggtacacgggtgcccgttgccgcctaccacggcccctccagtaccacctccacggagaaaaaggacggtcgtcctaacagagtcatccgtgtcttctgccttggcggagctcgctactaagaccttcggcagctctgaatcgtcggccgtcgacagcggcacggcgactgcccctcctgacgaggcctccggcggcggcgacaaaggatccgacgttgagtcgtactcctccatgcccccccttgagggagagccgggggaccccgacctcagcgacgggtcctggtctaccgtgagtgaggaggccagtgaggacgtcgtctgctgctcaatgtcctatacatggacaggcgccttgatcacgccatgtgctgcggaggagagcaagctgcccatcaacccgctgagcaactccttgctgcgtcaccacaacatggtctatgctacaacatcccgcagtgcaagcctacggcagaagaaggtcgcttttgacagaatgcaagtcctggacgaccactaccgggacgtgctcaaggagatgaaggcgaaggcgtccacagttaaggctaaactcctatccatagaagaggcctgcaagctgacgcccccacattcagccaaatccaaatttggctatggggcaaaagacgtccggaacctatccagcaaggccgttaaccacatccgctccgtgtggaaggacttgttggaagacaatgagacaccaatcaataccaccatcatggcaaaaaatgaggttttctgcgtccaaccagagaaaggaggccgtaagccagctcgccttatcgtattcccagacttgggagtccgtgtgtgcgagaagatggccctttatgacgtggtctccacccttcctcagcccgtgatgggctcctcatacggattccagtactctcctgggcagcgggtcgaattcctgctaaatgcctggaaatcaaaggaaaaccctatgggcttctcatatgacacccgctgttttgactcaacggtcactcagaacgacatccgtgttgaggagtcaatttaccaatgttgtgacttggcccccgaggccagacgggccataaagtcgctcacagagcggctctatatcgggggtcccctgactaattcaaaagggcagaactgcggttatcgccggtgccgcgcaagtggcgtgctgacgaccagctgcggtaatacccttacatgttacttgaaggcctctgcggcctgtcgagctgcgaagctgcaggactgcacgatgctcgtgaacggagacgaccttgtcgttatctgtgaaagcgcgggaactcaagaggatgcggcgagcctacgagtcttcacggaggctatgactaggtactctgccccccctggggacctgccccaaccagaatacgacttggagctaataacatcatgctcctccaatgtgtcagtcgcccacgatgcatctggcaaaagggtgtactacctcacccgtgaccccaccatccccctcgcgcgggctgcgtgggagacagctagacacactccagtcaactcctggctaggcaacatcatcatgtatgcgcccactctatgggcaaggatgattctgatgactcacttcttctccatccttctagctcaggagcaacttgagaaagccctggattgccaaatctacggggcctactactccattgagccacttgacctacctcagatcattgaacgactccatggccttagcgcattttcactccatagttactctccaggtgagatcaatagggtggcgtcatgtctcaggaaacttggggtaccacccttgcgagtctggagacatcgggccagaagcgtccgcgctaagctactgtcccagggggggagggccgccacttgtggcaagtacctcttcaactgggcagtaaagaccaagcttaaactcactccaatcccggctgcgtcccggttggacttgtccggctggttcgttgctggttacagcgggggagacatatatcacagcctgtctcgtgcccgaccccgttggttcatgttgtgcctactcctactttctgtaggggtaggcatctacctgctccccaaccgatgaacggggagataaacactccaggccaataggccatccc

SEQ ID NO: 6691 - DNA, 9441 bp, Human hepatitis C virus
  misc_feature 9382: n = a, t, c, or g
gccagccccctgatgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgacgcccacagaacgttaagttcccgggtggcggccagatcgttggcggagtttgcttgttgccgcgcaggggtcccagagtgggtgtgcgcgcgacgaggaagacttccgagcggtcacaacctcgcggaaggcgtcagcctattcccaaggcccgccgacccgagggcaggtcctgggcgcagcccgggtacccttggcccctctatggcaacgagggctgtgggtgggcaggatggctcttgtccccccgcggctcccggcctagtcggggcccctctgacccccggcgcaggtcacgcaatttgggtaaggtcatcgataccctcacgtgtggcttcgccgacctcatggggtacatcccgctcgtcggtgctcctctagggggcgctgctagggctctggcacatggtgttagggttctagaagacggcgtaaattacgcaacagggaaccttcctggttgctctttttctatcttcttgcttgctcttctctcctgcttgacagtccctgcttcggccgtcgaagtgcgcaactcttcggggatctaccatgtcaccaatgattgccccaatgcgtctgttgtgtacgagacagatagcttgatcatacatctgcccgggtgtgtgccctgcgtacgcgagggcaacgcttcgaggtgctgggtctcccttagtcctactgttgccgctaaggatccgggcgtccccgtcaacgagattcggcgtcacgtcgacctgattgtcggggccgctgcattctgttcggctatgtatgtaggggacttatgcggttccatcttcctcgttggccagcttttcaccctctcccctaggcgccactggacaacacaagactgtaattgctccatctacccaggacatgtgacaggccatcgaatggcttgggacatgatgatgaattggtcacctactggcgctttggtggtagcgcagctactccggatcccacaagccgtcttggatatgatagccggtgcccactggggtgtcctagcgggcccggcatactactccatggtggggaactgggctaaggttttggttgtgctactgctcttcgctggcgtcgatgcaaccacccaagtcacaggtggcaccgcgggccgtaatgcatatagattggctagcctcttctccaccggccccagccaaaatatccagctcataaactccaatggcagctggcacattaacaggactgccctgaattgcaatgacagcctgcacaccggctgggtagcagcgctgttctactcccacaagttcaactcttcggggcgtcctgagaggatggctagttgtcggcctcttaccgccttcgaccaagggtgggggcccatcacttacggggggaaagctagtaacgaccagcggccgtattgctggcactatgccccacgcccgtgcggtatcgtgccggcgaaagaggtttgcgggcctgtatactgtttcacacccagtcccgtggtagtggggacgacggacaagtacggcgttcctacctacacatggggcgagaatgagacggatgtactgctccttaacaactctaggccgccaatagggaattggttcgggtgtacgtggatgaattccactggtttcaccaagacgtgcggggctcctgcctgtaacgtcggcgggagcgagaccaacaccctgtcgtgccccacagattgcttccgcagacatccggacgcaacatacgctaagtgcggctctggcccttggcttaaccctcgatgcatggtggactacccttacaggctctggcactatccctgcacagtcaattacaccatattcaagatcaggatgttcgtgggcgggattgagcacaggctcaccgccgcgtgcaactggacgcggggagagcgctgcgacttggacgacagggatcgtgccgagttgagcccgctgttgctgtccaccacgcaatggcaggtcctcccctgctcattcacaacgctgcccgccctgtcaactggcctaatacatctccaccagaacatcgtggacgtgcagtacctctacgggttgagctcggtagttacatcctgggccataaggtgggagtatgtcgtgctccttttcttgctgttagcagatgcccgcatttgtgcctgcctttggatgatgcttctcatatcccaggtagaggcggcgctggagaacctgatagtcctcaacgctgcttccctggctgggacacacggcatcgtccctttcttcatctttttttgtgcagcctggtatctgaaaggcaagtgggcccctggactcgtctactccgtctacggaatgtggccgctgctcctgcttctcctggcgttgccccaacgggcgtacgccttggatcaggagttggccgcgtcgtgtggggccgtggtcttcatcagcctagcggtacttaccctgtcgccgtactacaaacagtacatggcccgcggcatctggtggctgcagtacatgctgaccagagcggaggcgctcctgcacgtctgggtcccctcgctcaacgcccggggagggcgtgatggtgccatactgctcatgtgtgtgctccacccgcacttgctctttgacatcaccaaaatcatgctggccattctcgggcccctgtggatcttgcaggccagtctgctcagggtgccgtacttcgtgcgcgcccacggtctcattaggctctgcatgctggtgcgcaaaacagcgggcggtcactatgtgcagatggctctgttgaagctgggggcacttactggcacttacatttacaaccacctttccccactccaagactgggctcatggcagcttgcgtgatctagcggtggccaccgagcccgtcatcttctcccggatggagatcaagactatcacctggggggcagacaccgcggcctgtggagacatcatcaacgggctgcctgtttctgctcggagggggagagaggtgttgttgggaccagccgatgccctgactgacaagggatggaggcttttagcccccatcacagcttacgcccaacagacacgaggtctcttgggctgtattgtcaccagcctcaccggtcgggacaaaaatcaagtggagggggaaatccagattgtgtctaccgcaacccagacgttcttggccacttgcatcaacggagcttgctggactgtttatcatggggccggatcgaggaccatcgcttcggcgtcgggtcctgtggtccggatgtacaccaatgtggaccaggatttggtgggctggccagcgcctcagggagcgcgctccctgacgccgtgcacgtgcggtgcctcggatctgtacttggtcacgaggcacgcggatgtcatcccagtgcggcgtcgaggcgataacaggggaagcttgctttctccccggcccatctcatacctaaaaggatcctcgggaggccctctgctctgccccatgggacatgtcgcgggcatttttagggccgcggtgtgcacccgtggggttgcaaaggcggtcgactttgtgcccgttgagtccttagagaccaccatgaggtccccagtgtttactgacaattccagccctccaacagtgccccagagttaccaggtggcacatctacatgcacccactgggagtggcaagagcacgaaggtgccggccgcttacgcagctcaagggtacaaggtacttgtgctgaacccgtctgttgctgccaccttagggttcggtgcttatatgtcaaaggcccatgggattgacccaaacgtcaggaccggcgtgaggaccattaccacaggctcccccatcacctactccacctacgggaaatttttggctgatggcggatgcccaggaggtgcgtacgacatcataatatgtgacgaatgtcactcagtggacgccacctcgattctgggcatagggaccgtcttggaccaagcggagacggcgggggttaggctcactgtccttgccaccgctacaccacctggcttggtcaccgtgccacattccaacatcgaggaagttgcactgtccgctgacggggagaaaccattttatggtaaggccatccccctaaactacatcaagggggggaggcatctcattttctgtcattccaagaagaagtgcgacgagctcgctgcaaagctggtcggtctgggcgtcaacgcggtggccttttaccgtggcctcgacgtatctgtcattccaactacaggagacgtcgttgttgtagcgaccgacgccttgatgactggcttcaccggcgatttcgactctgtgatagactgcaacacctgtgtcgtccagacagtcgacttcagcctagaccctatattctctattgagacttccaccgtgccccaggacgccgtgtcccgctcccaacggaggggtaggaccggtcgagggaagcatggtatttacagatatgtgtcacccggggagcggccgtctggcatgttcgactccgtggtcctctgtgagtgctatgacgcgggttgtgcttggtacgagcttacacccgccgagaccacagtcaggctacgggcataccttaacaccccaggattgcccgtgtgccaggaccacttggagttctgggagagtgtcttcaccggcctcacccacatagatgcccacttcctgtcccagacgaaacagagtggggagaacttcccctacctagtcgcataccaagccaccgtgtgcgctagagctagagctcctcccccgtcatgggaccaaatgtggaagtgcctgatacggctcaagcccaccctcactggggctaccccattactatacagactgggtagtgtacagaatgagatcaccttaacacacccaatcacccaatacatcatggcttgcatgtcggcggacctggaggtcgtcactagcacgtgggtgttggtgggcggcgtcctagccgctttggccgcttactgcctgtccacaggcagcgtggtcatagtgggcaggataatcctaggtgggaagccggcagtcatacctgacagggaggttctctaccgagagtttgatgagatggaggagtgcgccgcccacgtcccctacctcgagcaggggatgcatttggctggacagttcaagcagaaagctctcgggttgctccagacagcatccaagcaagcggagacgatcactcccactgtccgcaccaactggcagaaactcgagtccttctgggctaagcacatgtggaacttcgttagcgggatacaatacctggcgggcctgtcaacgctgcccgggaaccccgctatagcgtcgctgatgtcgtttacggccgcggtgacgagtccactaaccacccagcaaaccctcttctttaacatcttaggggggtgggtggcggcccagcttgcttccccagctgccgctactgcttttgtcggtgctggtattactggcgccgttgttggcagtgtgggcctagggaaggtcctagtggacattattgctggctacggggctggtgtggcgggggccctcgtggctttcaaaatcatgagcggggagacccccaccaccgaggatctagtcaaccttctgcctgccatcctatcgccaggagctctcgttgtcggcgtggtgtgcgcagcaatactacgccggcacgtgggccctggcgagggcgccgtgcagtggatgaaccggctgatagcgtttgcttctcggggtaaccacgtctcccctacacactacgtgccggagagcgacgcgtcggctcgtgtcacacaaattctcaccagcctcactgttactcagcttctgaaaaggctccacgtgtggataagctcggattgcatcgccccgtgtgctagttcttggcttaaagatgtctgggactggatatgcgaggtgctgagcgacttcaagaattggctgaaggccaaacttgtaccacaactgcccgggatcccattcgtatcctgccaacgcgggtaccgtggggtctggcggggcgagggcatcgtgcacactcgttgcccgtgtggggccaatataactggacatgtcaagaacggttcgatgagaatcgtcgggcctaagacttgcagcaacacctggcgtgggtcgttccccattaacgcttacactacaggcccgtgcacgccctccccggcgccgaactatacgttcgcgctatggagggtgtctgcagaggagtatgtggaggtaaggcggctgggggacttccattacgtcacgggggtgaccactgataaactcaagtgtccatgccaggtcccctcacccgagttcttcacagaggtggacggggtgcgcctgcataggtacgcccccccctgcaaacccctgctgcgagaagaggtgacgtttagcatcgggctcaatgaatacttggtggggtcccagttgccctgcgagcccgagccagacgtagctgtactgacatcaatgcttacagacccctcccacatcactgcagagacggcagcgcgtaggctgaagcgggggtctcccccctccctggccagctcttccgccagccagctgtccgcgccgtcactgaaggcaacatgcaccactcaccacgactctccagacgctgacctcatagaagccaacctcctgtggagacaggagatgggggggaacatcactagggtggagtcggagaacaagattgtcgttctggattctttcgacccgctcgtagcggaggaggatgatcgggagatctctattccagctgagattctgcggaagttcaagcagtttcctcccgctatgcccatatgggcacggccagattataatcctccccttgtggaaccgtggaagcgcccggactatgagccacccttagtccacgggtgccccctaccacctcccaagccaactccggtgccgccaccccggagaaagaggacggtggtgctggacgagtctacagtatcatctgctctggctgagcttgccactaagaccttcggcagctctacaacctcaggcgtgacaagtggtgaagcgactgaatcgtccccggcgccctcctgcggcggtgagctggactccgaagctgaatcttactcctccatgccccctctcgagggggagccgggggaccccgatctcagcgacgggtcttggtctaccgtgagcagtgatggtggcacggaagacgttgtgtgctgctcgatgtcttactcgtggacgggcgctttaatcacgccctgtgcctcagaggaagccaagctccctatcaacgcattgagcaactcgctgctgcgccaccacaacttggtgtattccaccacctctcgcagcgctggccagagacagaaaaaagtcacatttgacagagtgcaagtcctggacgaccattaccgggacgtgctcaaggaggctaaggccaaggcatccacggtgaaggctagactgctatccgttgaggaagcgtgtagcctgacgcccccacactccgccagatcaaaatttggctatggggcgaaggatgtccgaagccattccagtaaggctatacgccacatcaactccgtgtggcaggaccttctggaggacaatacaacacccatagacactaccatcatggcaaagaatgaggtcttctgtgtgaagcccgaaaaggggggccgcaagcccgctcgtcttatcgtgtaccccgacctgggagtgcgcgtatgcgagaagagggctttgtatgacgtagtcaaacagctccccattgccgtgatgggagcctcctacgggttccagtactcaccagcgcagcgggtcgacttcctgcttaaagcgtggaaatctaagaaagtccccatggggttttcctatgacacccgttgctttgactcaacagtcactgaggctgatatccgtacggaggaagacctctaccaatcttgtgacctggcccctgaggctcgcatagccataaggtccctcacagagaggctttacatcgggggcccactcaccaattctaagggacaaaactgcggctatcggcgatgccgcgcaagcggcgtgctgaccactagctgcggtaacaccataacctgcttcctcaaagccagtgcagcctgtcgagctgcgaagctccaggactgcaccatgctcgtgtgcggcgacgacctcgtcgttatctgtgagagcgccggtgtccaggaggacgctgcgagcctgagagccttcacggaggctatgaccaggtactccgcccccccgggagacccgcctcaaccagaatacgacttggagcttataacatcctgctcctccaatgtgtcggtcgcgcgcgacggcgctggcaaaagggtctattatctgacccgtgaccctgagactcccctcgcgcgtgccgcttgggagacagcaagacacactccagtgaactcctggctaggcaacatcatcatgtttgcccccactctgtgggtacggatggtcctcatgacccattttttctccatactcatagctcaggagcaccttggaaaggctctagattgtgaaatctatggagccgtacactccgtccaaccgttggacttacctgaaatcatccaaagactccacagcctcagcgcgttttcgctccacagttactctccaggtgaaatcaatagggtggctgcatgcctcaggaagcttggggttccgcccttgcgagcttggagacaccgggcccggagcgttcgcgccacactcctatcccagggggggaaagccgctatatgcggtaagtacctcttcaactgggcggtgaaaaccaaactcaaactcactccattaccgtccatgtctcagttggacttgtccaactggttcacgggcggttacagcgggggagacatttatcacagcgtgtctcatgcccggccccgtttgttcctctggtgcctactcctactttcagtaggggtaggcatctatctccttcccaaccgatagacggntgggcaaccactccgggtctttaggccctatttaaacactccaggcctttaggccccgt

SEQ ID NO: 6692 - DNA, 2755 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtaaaaaaaaaaaaaaaaaaaaaaaaaaaaaaaaaaaaaaaaaaaaaaaaaaaaaaaaaaaaaaaaaaa

SEQ ID NO: 6693 - DNA, 2759 bp, Homo sapiens
gaattcccaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaagggtgggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctatagttttatgttaaatcaataaagaccactttacaaaagtattatcagatgctttcctgcacattaaggagaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacatggctcacgcctgtaatcctagcagtttgggaggctgagccgggtggatcgcctgaggtcaggagttcaagacaagcctggcctacatggtgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcttccatcctcaacacccaactgtctcgatgcaatgaacacttaataaaaaacagtcgattggtcaaaaaaaaaaaaaaaaaaaaaaaaagaattc

SEQ ID NO: 6694 - DNA, 2570 bp, Homo sapiens
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcag

SEQ ID NO: 6695 - DNA, 3622 bp, Homo sapiens
cccggggaggggaccggggaacagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtggttcgggagtgtccagagagccttgtctccagccggccccgggaggagagccctgctgcccaggcgctgttgacagcggcggaaagcagcggtaccccacgcgcccgccgggggacgtcggcgagcggctgcagcagcaaagaactttcccggcggggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcacgccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggaggggttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttcggtctgacggcgcccccagtgtgcacgagtgggaaggacttggtcgcgccctcccttggcgtggagccagggagcggccgcctgcgggctgccccgctttgcggacgggctgtccccgcgcgaacggaacgttggactttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgctttcgttaactgtgtatgtacatatatatattttttaatttgattaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatcctagtctatctaggtggagttgaaagagttaagaatgctcgataaaatcactctcagtgcttcttactattaagcagtaaaaactgttctctattagacttagaaataaatgtacctgatgtacctgatgctatgtcaggcttcatactccacgctcccccagcgtatctatatggaattgcttaccaaaggctagtgcgatgtttcaggaggctggaggaaggggggttgcagtggagagggacagcccactgagaagtcaaacatttcaaagtttggattgcatcaagtggcatgtgctgtgaccatttataatgttagaaattttacaataggtgcttattctcaaagcaggaattggtggcagattttacaaaagatgtatccttccaatttggaatcttctctttgacaattcctagataaaaagatggcctttgtcttatgaatatttataacagcattctgtcacaataaatgtattcaaataccaataacagatcttgaattgcttccctttactacttttttgttcccaagttatatactgaagtttttatttttagttgctgaggtt

SEQ ID NO: 6696 - DNA, 5444 bp, Homo sapiens
ctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccattttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacaccatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtttacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 6697 - DNA, 2657 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggcagaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaacgtcacgcccataggctacatccccaaggaggatgccctgaacctgaaaggcctggggcacatcaacatgatggagcttttcagcatctccaaggaattctgggacaaggaggtggaagacatcgagaagtatctggtggatcaagtcaatgccgacctcccctgtgaaatcgagagagagatccttgccttgaagcaaagaataagccagatgtaatcagggcctgagaataagccagatgtaatcagggcctgagtgctttacctttaaaatcattaaattaaaatccataaggtgcagtaggagcaagagagggcaagtgttcccaaattgacgccacctaataatcatcaccacaccgggagcagatctgaaggcacactttgatttttttaaggataagaaccacagaacactgggtagtagctaatgaaattgagaagggaaatcttagcatgcctccaaaaattcacatccaatgcatactttgttcaaatttaaggttactcaggcattgatcttttcagtgttttttcacttagctatgtggattagctagaatgcacaccaaaaagatacttgagctgtatatatatatgtgtgtgtgtgtgtgtgtgtgtgtgtgtgtgcatgtatgtgcacatgtgtctgtgtgatatttggtatgtgtatttgtatgtactgttattcaaaatatatttaatacctttggaaaatcttgggcaagatgacctactagttttccttgaaaaaaagttgctttgttattaatattgtgcttaaattatttttatacaccattgttccttacctttacataattgcaatatttcccccttactacttcttggaaaaaaattagaaaatgaagtttatagaaaag

SEQ ID NO: 6698 - DNA, 2259 bp, Mus musculus
agcagagggatcggggccaaccgggcttggactcactgcacgggctctgctggcagcttcctgaggtaccaagggaggaaggatggaggaaggaatgaacattctccatgactttgggatccagtcgactcgctatctccaagtgaattaccaagactcccaggactggttcatccttgtgtctgtgattgctgacctgaggaacgccttctatgtcctctttcccatctggttccatcttaaagagactgtgggcatcaatctcctctgggtggcagtggtcggagactggttcaacctcgtcttcaagtggattctgtttggacaacgcccgtattggtgggtcctggacaccgactactacagcaacagctccgtgcctataataaagcagttccctgtcacctgtgagaccggaccaggaagtccctctggccatgccatgggcgcagcaggtgtatactatgttatggtcacttctactcttgctatctttcgaggaaagaaaaagccaacgtatggattccggtgtttgaacgtcatcttgtggttgggattctgggctgtgcagctgaacgtctgtctgtcccggatctaccttgctgctcactttccccaccaggtcgtggctggagtcttgtcaggcattgctgtggctgaaactttcagccacatccggggcatctacaatgccagcctccggaagtattgtctcatcaccatcttcttgtttggtttcgcgcttggattctacctgctactaaaagggctaggggtggacctcctgtggactttggagaaagccaagagatggtgtgagcggccagaatgggtccaccttgacactacaccctttgccagcctcttcaaaaacctgggaaccctcttggggttggggctggccctcaactccagcatgtaccggaagagctgcaagggagaactcagcaagtcgttcccattccgcttcgcctgcattgtggcttccttggtcctcctgcatctctttgactctctgaagcccccatcccaggttgagttgatcttctacatcttgtctttctgcaagagcgcaacagttccctttgcatctgtcagtcttatcccatactgcctagcccggatcctgggacagacacacaagaagtctttgtaaggcatgcagagtctttggtatttaaagtcaaccgccatgcaaaggactaggaacaactaaagcctctgaaacccattgtgaggccagaggtgttgacatcggccctggtagccctgtctttctttgctatcttaaccaaaaggtgaatttttacaaagcttacagggctgtttgaggaaagtgtgaatgctggaaactgagtcattctggatggttccctgaagattcgcttaccagcctcctgtcagatacagaagagcaagcccaggctagagatcccaactgagaatgctcttgcggtgcagaatcttccggctgggaaaaggaaaagagcaccatgcatttgccaggaagagaaagaaggatcgggaggagggagagtgttttatgtatcgagcaaaccagatgcaatctatgtctaaccggcttcagttgtgtctgcgtctttagatacgacacactcaataataataatagaccaactagtgtaatgagtagccagttaaaggcgattaattctgcttccagatagtctccactgtacataaaagtcacactgtgtgcttgcattcctgtatggtagtggtgactgtctctcacaccaccttctctatcacgtcacagttttctcctcctcagcctatgtctgcattccccagaattctccacttgttccctggccctgctgctggaccctgctgtgtctggtaggcaactgtttgttggtgcttttgtagggttaagttaaactctgagatcttgggcaaaatggcaaggagacccaggattcttctctccaaaggtcactccgatgttatttttgattcctggggcagaaatatgactcctttccctagcccaagccagccaagagctctcattcttagaagaaaaggcagccccttggtgcctgtcctcctgcctcggctgatttgcagagtacttcttcaaaaagaaaaaaatggtaaagctatttattaaaaattctttgttttttgctacaaatgatgcatatattttcacccacaccaagcactttgtttctaatatctttgataagaaaactacatgtgcagtattttattaaagcaacattttattta

SEQ ID NO: 6699 - DNA, 2618 bp, Mus musculus
acagttggccttccctctgggaacacaccctcggtcaacaggggaaatccggcaaggcgctcagcgatctctgatccagaccttccaaaaggaagaaaggtggcaccagagttcctgcctctctccacaccattgcaattatgcctcctcagctgcataacggtctggacttctctgccaaggttatccagggcagcctcgacagcctgccccaggcagtgaggaagttcgtggaaggcaatgctcagctgtgccagccggagtatatccacatctgcgatggctccgaggaggagtacgggcagttgctggcccacatgcaggaggagggtgtcatccgcaagctgaagaaatatgacaactgttggctggctctcactgaccctcgagatgtggccaggatcgaaagcaagacagtcatcatcacccaagagcagagagacacagtgcccatccccaaaactggcctcagccagctgggccgctggatgtcggaagaggactttgagaaagcattcaacgccaggttcccagggtgcatgaaaggccgcaccatgtatgtcatcccattcagcatggggccactgggctcgccgctggccaagattggtattgaactgacagactcgccctatgtggtggccagcatgcggatcatgactcggatgggcatatctgtgctggaggccctgggagatggggagttcatcaagtgcctgcactctgtggggtgccctctccccttaaaaaagcctttggtcaacaactgggcctgcaaccctgagctgaccctgatcgcccacctcccggaccgcagagagatcatctcctttggaagcggatatggtgggaactcactactcgggaagaaatgctttgcgttgcggatcgccagccgtctggctaaggaggaagggtggctggcggagcatatgctgatcctgggcataactaaccccgaaggcaagaagaaatacctggccgcagccttccctagtgcctgtgggaagactaacttggccatgatgaaccccagcctgcccgggtggaaggtcgaatgtgtgggcgatgacattgcctggatgaagtttgatgcccaaggcaacttaagggctatcaacccagaaaacgggttttttggagttgctcctggcacctcagtgaagacaaatccaaatgccattaaaaccatccagaaaaacaccatcttcaccaacgtggccgagactagcgatgggggtgtttactgggaaggcatcgatgagccgctggccccgggagtcaccatcacctcctggaagaacaaggagtggagaccgcaggacgcggaaccatgtgcccatcccaactcgagattctgcacccctgccagccagtgccccattattgaccctgcctgggaatctccagaaggagtacccattgagggtatcatctttggtggccgtagacctgaaggtgtcccccttgtctatgaagccctcagctggcagcatggggtgtttgtaggagcagccatgagatctgaggccacagctgctgcagaacacaagggcaagatcatcatgcacgacccctttgccatgcgacccttcttcggctacaacttcggcaaatacctggcccactggctgagcatggcccaccgcccagcagccaagttgcccaagatcttccatgtcaactggttccggaaggacaaagatggcaagttcctctggccaggctttggcgagaactcccgggtgctggagtggatgttcgggcggattgaaggggaagacagcgccaagctcacgcccatcggctacatccctaaggaaaacgccttgaacctgaaaggcctggggggcgtcaacgtggaggagctgtttgggatctctaaggagttctgggagaaggaggtggaggagatcgacaggtatctggaggaccaggtcaacaccgacctcccttacgaaattgagagggagctccgagccctgaaacagagaatcagccagatgtaaatcccaatgggggcgtctcgagagtcaccccttcccactcacagcatcgctgagatctaggagaaagccagcctgctccagctttgagatagcggcacaatcgtgagtagatcagaaaagcaccttttaatagtcagttgagtagcacagagaacaggctaggggcaaataagattgggaggggaaatcaccgcatagtctctgaagtttgcatttgacaccaatgggggttttggttccacttcaaggtcactcaggaatccagttcttcacgttagctgtagcagttagctaaaatgcacagaaaacatacttgagctgtatatatgtgtgtgaacgtgtctctgtgtgagcatgtgtgtgtgtgtgtgtgtgtgtgtgtgtgtgtgtgtgtgtgtgtgtgtacatgcctgtctgtcccattgtccacagtatatttaaaacctttggggaaaaatcttgggcaaatttgtagctgtaactagagagtcatgttgctttgttgctagtatgtatgtttaaattatttttatacaccgcccttacctttctttacataattgaaattggtatccggaccacttcttgggaaaaaaattacaaaataaa

SEQ ID NO: 6700 - RNA, 21 nt, Artificial Sequence
  Test iRNA agent targeting Luciferase
gaacugugugugagagguccu

SEQ ID NO: 6701 - RNA, 23 nt, Artificial Sequence
  Test iRNA agent targeting Luciferase
aggaccucucacacacaguucgc

SEQ ID NO: 6702 - RNA, 23 nt, Artificial Sequence
  Test iRNA agent targeting Luciferase
gaacugugugugagagguccugs

SEQ ID NO: 6703 - RNA, 23 nt, Artificial Sequence
  Test iRNA agent targeting Luciferase
aggaccucucacacacaguucgc

SEQ ID NO: 6704 - RNA, 21 nt, Artificial Sequence
  Test iRNA agent targeting Luciferase
gaacugugugugagagguccu

SEQ ID NO: 6705 - RNA, 23 nt, Artificial Sequence
  Test iRNA agent targeting Luciferase
  misc_feature 22: n = Gs = phosphorothioate linkages
  misc_feature 23: n = Cs = phosphorothioate linkages
aggaccucucacacacaguucnn

SEQ ID NO: 6706 - RNA, 21 nt, Artificial Sequence
  Test iRNA agent targeting Luciferase
gaacugugugugagagguccu

SEQ ID NO: 6707 - RNA, 23 nt, Artificial Sequence
  Test iRNA agent targeting Luciferase
  misc_feature 22: n = Gs = phosphorothioate linkages
  misc_feature 23: n = Cs = phosphorothioate linkages
aggaccucucacacacaguucnn

SEQ ID NO: 6708 - DNA, 21 bp, Mus musculus
aagtttgggcagctctgctct

SEQ ID NO: 6709 - DNA, 21 bp, Mus musculus
aagtggacataccgattgact

SEQ ID NO: 6710 - DNA, 21 bp, Mus musculus
aactcagaactgaagggcgcc

SEQ ID NO: 6711 - DNA, 21 bp, Mus musculus
aagggcgcccagacatgaaaa

SEQ ID NO: 6712 - DNA, 21 bp, Mus musculus
aagataggagcccagcttcga

SEQ ID NO: 6713 - DNA, 21 bp, Artificial Sequence
  siRNA
  misc_feature 20, 21: n = deoxythymidine
guuugggcagcucugcucunn

SEQ ID NO: 6714 - DNA, 21 bp, Artificial Sequence
  siRNA
  misc_feature 20, 21: n = deoxythymidine
agagcagagcugcccaaacnn

SEQ ID NO: 6715 - DNA, 21 bp, Artificial Sequence
  siRNA
  misc_feature 20, 21: n = deoxythymidine
guggacauaccgauugacunn

SEQ ID NO: 6716 - DNA, 21 bp, Artificial Sequence
  siRNA
  misc_feature 20, 21: n = deoxythymidine
agucaaucgguauguccacnn

SEQ ID NO: 6717 - DNA, 21 bp, Artificial Sequence
  siRNA
  misc_feature 20, 21: n = deoxythymidine
cucagaacugaagggcgccnn

SEQ ID NO: 6718 - DNA, 21 bp, Artificial Sequence
  siRNA
  misc_feature 20, 21: n = deoxythymidine
ggcgcccuucaguucugagnn

SEQ ID NO: 6719 - DNA, 21 bp, Artificial Sequence
  siRNA
  misc_feature 20, 21: n = deoxythymidine
gauaggagcccagcuucgann

SEQ ID NO: 6720 - DNA, 21 bp, Artificial Sequence
  siRNA
  misc_feature 20, 21: n = deoxythymidine
ucgaagcugggcuccuaucnn

SEQ ID NO: 6721 - DNA, 24 bp, Artificial Sequence
  siRNA
  misc_feature 19, 21, 23: n = thiophosphate
  misc_feature 22, 24: n = deoxythymidine
guuugggcagcucugcucnunnnn

SEQ ID NO: 6722 - DNA, 24 bp, Artificial Sequence
  siRNA
  misc_feature 19, 21, 23: n = thiophosphate
  misc_feature 22, 24: n = deoxythymidine
agagcagagcugcccaaancnnnn

SEQ ID NO: 6723 - DNA, 24 bp, Artificial Sequence
  siRNA
  misc_feature 19, 21, 23: n = thiophosphate
  misc_feature 22, 24: n = deoxythymidine
guggacauaccgauugacnunnnn

SEQ ID NO: 6724 - DNA, 24 bp, Artificial Sequence
  siRNA
  misc_feature 19, 21, 23: n = thiophosphate
  misc_feature 22, 24: n = deoxythymidine
agucaaucgguauguccancnnnn

SEQ ID NO: 6725 - DNA, 24 bp, Artificial Sequence
  siRNA
  misc_feature 19, 21, 23: n = thiophosphate
  misc_feature 22, 24: n = deoxythymidine
cucagaacugaagggcgcncnnnn

SEQ ID NO: 6726 - DNA, 24 bp, Artificial Sequence
  siRNA
  misc_feature 19, 21, 23: n = thiophosphate
  misc_feature 22, 24: n = deoxythymidine
ggcgcccuucaguucugangnnnn

SEQ ID NO: 6727 - DNA, 24 bp, Artificial Sequence
  siRNA
  misc_feature 19, 21, 23: n = thiophosphate
  misc_feature 22, 24: n = deoxythymidine
gauaggagcccagcuucgnannnn

SEQ ID NO: 6728 - DNA, 24 bp, Artificial Sequence
  Synthetically generated siRNA
  misc_feature 19, 21, 23: n = thiophosphate
  misc_feature 22, 24: n = deoxythymidine
ucgaagcugggcuccuauncnnnn

SEQ ID NO: 6729 - RNA, 21 nt, Artificial Sequence
  Synthetically generated siRNA
guuugggcagcucugcucucu

SEQ ID NO: 6730 - RNA, 23 nt, Artificial Sequence
  Synthetically generated siRNA
agagagcagagcugcccaaacuu

SEQ ID NO: 6731 - RNA, 21 nt, Artificial Sequence
  Synthetically generated siRNA
guggacauaccgauugacuga

SEQ ID NO: 6732 - RNA, 23 nt, Artificial Sequence
  Synthetically generated siRNA
ucagucaaucgguauguccacuu

SEQ ID NO: 6733 - RNA, 21 nt, Artificial Sequence
  Synthetically generated siRNA
cucagaacugaagggcgccca

SEQ ID NO: 6734 - RNA, 23 nt, Artificial Sequence
  Synthetically generated siRNA
ugggcgcccuucaguucugaguu

SEQ ID NO: 6735 - RNA, 21 nt, Artificial Sequence
  Synthetically generated siRNA
gauaggagcccagcuucgagu

SEQ ID NO: 6736 - RNA, 23 nt, Artificial Sequence
  Synthetically generated siRNA
acucgaagcugggcuccuaucuu

SEQ ID NO: 6737 - protein, 16 aa, Artificial Sequence
  Exemplary Cell Permeation Peptide
RQIKIWFQNRRMKWKK

SEQ ID NO: 6738 - protein, 14 aa, Artificial Sequence
  Exemplary Cell Permeation Peptide
GRKKRRQRRRPPQC

SEQ ID NO: 6739 - protein, 27 aa, Artificial Sequence
  Exemplary Cell Permeation Peptide
GALFLGWLGAAGSTMGAWSQPKKKRKV

SEQ ID NO: 6740 - protein, 18 aa, Artificial Sequence
  Exemplary Cell Permeation Peptide
LLIILRRRIRKQAHAHSK

SEQ ID NO: 6741 - protein, 26 aa, Artificial Sequence
  Exemplary Cell Permeation Peptide
GWTLNSAGYLLKINLKALAALAKKIL

SEQ ID NO: 6742 - protein, 18 aa, Artificial Sequence
  Exemplary Cell Permeation Peptide
KLALKLALKALKAALKLA

SEQ ID NO: 6743 - protein, 9 aa, Artificial Sequence
  Exemplary Cell Permeation Peptide
RRRRRRRRR

SEQ ID NO: 6744 - protein, 10 aa, Artificial Sequence
  Exemplary Cell Permeation Peptide
KFFKFFKFFK

SEQ ID NO: 6745 - protein, 37 aa, Artificial Sequence
  Exemplary Cell Permeation Peptide
LLGDFFRKSKEKIGKEFKRIVQRIKDFLRNLVPRTES

SEQ ID NO: 6746 - protein, 31 aa, Artificial Sequence
  Exemplary Cell Permeation Peptide
SWLSKTAKKLENSAKKRISEGIAIAIQGGPR

SEQ ID NO: 6747 - protein, 30 aa, Artificial Sequence
  Exemplary Cell Permeation Peptide
ACYCRIPACIAGERRYGTCIYQGRLWAFCC

SEQ ID NO: 6748 - protein, 36 aa, Artificial Sequence
  Exemplary Cell Permeation Peptide
DHYNCVSSGGQCLYSACPIFTKIQGTCYRGKAKCCK

SEQ ID NO: 6749 - protein, 12 aa, Artificial Sequence
  Exemplary Cell Permeation Peptide
RKCRIVVIRVCR

SEQ ID NO: 6750 - protein, 42 aa, Artificial Sequence
  Exemplary Cell Permeation Peptide
RRRPRPPYLPRPRPPPFFPPRLPPRIPPGFPPRFPPRFPGKR

SEQ ID NO: 6751 - protein, 13 aa, Artificial Sequence
  Exemplary Cell Permeation Peptide
ILPWKWPWWPWRR

SEQ ID NO: 6752 - protein, 16 aa, Artificial Sequence
  Synthetically generated peptide
AAVALLPAVLLALLAP

SEQ ID NO: 6753 - protein, 11 aa, Artificial Sequence
  Synthetically generated peptide
AALLPVLLAAP

SEQ ID NO: 6754 - protein, 13 aa, Human immunodeficiency virus
GRKKRRQRRRPPQ

SEQ ID NO: 6755 - protein, 16 aa, Drosophila Antennapedia
RQIKIWFQNRRMKWKK

SEQ ID NO: 6756 - DNA, 23 bp, Mus musculus
aagctggccctggacatggagat

What is claimed is:

1. An iRNA agent, comprising: a sense strand sequence having 4-12 asymmetrical 2'-O-alkyl modifications, at least 4 of which occur at the 4 terminal nucleotides of the 5' end; and an antisense sequence having at least 4 asymmetrical phosphorothioate modifications.

2. The iRNA agent of claim 1, wherein the sense and antisense sequences of the iRNA agent are on different RNA strands.

3. The iRNA agent of claim 1, wherein the sense and antisense sequences of the iRNA agent are on the same RNA strand.

4. The iRNA agent of claim 1, wherein the sense and antisense sequences of the iRNA agent are fully complementary to each other.

5. The iRNA agent of claim 1, further comprising a cholesterol moiety. wherein the cholesterol moiety is coupled to the sense sequence of the iRNA agent.

6. The iRNA agent of claim 1, wherein the iRNA agent is at least 21 nucleotides in length, and the duplex region of the iRNA agent is about 19 nucleotides in length.

7. The iRNA agent of claim 1, the iRNA agent having a duplex region of about 19 nucleotides in length and one or two 3' overhangs of about 2 nucleotides in length.

8. An iRNA agent, comprising: a sense strand sequence having 4-12 asymmetrical 2'-O-alkyl modifications, at least 4 of which occur at the 4 terminal nucleotides of the 3' end; and an antisense sequence having at least 4 asymmetrical phosphorothioate modifications.

9. The iRNA agent of claim 8, wherein the sense and antisense sequences of the iRNA agent are on different RNA strands.

10. The iRNA agent of claim 8, wherein the sense and antisense sequences of the iRNA agent are on the same RNA strand.

11. The iRNA agent of claim 8, wherein the sense and antisense sequences of the iRNA agent are fully complementary to each other.

12. The iRNA agent of claim 8, further comprising a cholesterol moiety, wherein the cholesterol moiety is coupled to the sense sequence of the iRNA agent.

13. The iRNA agent of claim 8, wherein the iRNA agent is at least 21 nucleotides in length, and the duplex region of the iRNA agent is about 19 nucleotides in length.

14. The iRNA agent of claim 8, the iRNA agent having a duplex region of about 19 nucleotides in length and one or two 3' overhangs of about 2 nucleotides in length.

15. The iRNA agent of claim 1, wherein the sense strand sequence has 6-12 asymmetrical 2'-O-alkyl modifications, at least 6 of which occur at the 6 terminal nucleotides of the 5' end.

16. The iRNA agent of claim 15, wherein the sense strand sequence has 6 asymmetrical 2'-O-alkyl modifications at the 6 terminal nucleotides of the 5' end.

17. The iRNA agent of claim 1, wherein the sense strand sequence comprises 8-12 asymmetrical 2'-O-alkyl modifications, at least 4 of which occur at the 4 terminal nucleotides of the 3' end.

18. The iRNA agent of claim 16, wherein the sense strand sequence has 6 asymmetrical 2'-O-alkyl modifications at the 6 terminal nucleotides of the 3' end.

19. The iRNA agent of claim 1, wherein the antisense sequence contains 4-20 asymmetrical phosphorothioate modifications.

20. The iRNA agent of claim 1, wherein each of the 2'-O-alkyl modifications are 2'-O-methyl modifications.

21. The iRNA agent of claim 8, wherein the sense strand sequence has 6-12 asymmetrical 2'-O-alkyl modifications, at least 6 of which occur at the 6 terminal nucleotides of the 3' end.

22. The iRNA agent of claim 21, wherein the sense strand sequence has 6 asymmetrical 2'-O-alkyl modifications at the 6 terminal nucleotides of the 3' end.

23. The iRNA agent of claim 8, wherein the antisense sequence contains 4-20 asymmetrical phosphorothioate modifications.

24. The iRNA agent of claim 8, wherein each of the 2'-O-alkyl modifications are 2'-O-methyl modifications.

25. The iRNA agent of claim 1, wherein the sense strand further comprises at least one asymmetric modification selected from the group consisting of 2'-5'-linkages, L sugars, modified sugars. nucleobase modifications, cation groups, Zwitterionic groups, and conjugate groups.

26. The iRNA agent of claim 25, wherein the modification is 2'-5' linkages, and the 2'-5' linkage is phosphorothioate.

27. The iRNA agent of claim 25, wherein the modification is L sugars. and the L sugar is L ribose or L-arabinose sugar.

28. The iRNA agent of claim 25, wherein the modification is modified sugars, and the modified sugar is a locked nucleic acid, hexose nucleic acid or cyclohexane nucleic acid.

29. The iRNA agent of claim 25, wherein the conjugate group is naproxen, biotin, ibuprofen, folic acid. peptides or carbohydrates.

30. The iRNA agent of claim 1, wherein the antisense strand further comprises at least one asymmetric modification selected from the group consisting of 2'-5'-linkages, L sugars, modified sugars, nucleobase modifications. cation groups. Zwitterionic groups. and conjugate groups.

31. The iRNA agent of claim 30, wherein the modification is 2'-5' linkages, and the 2'-5' linkage is phosphorothioate.

32. The iRNA agent of claim 30, wherein the modification is L sugars, and the L sugar is L ribose or L-arabinose sugar.

33. The iRNA agent of claim 30, wherein the modification is modified sugars, and the modified sugar is a locked nucleic acid, hexose nucleic acid or cyclohexane nucleic acid.

34. A method of making the iRNA agent of claim 1, comprising the steps of providing the modified sense strand sequence, and the modified antisense sequence, and hybridizing the sense and antisense strands to form the iRNA agent.

35. A method of making the iRNA agent of claim 8, comprising the steps of providing the modified sense strand sequence, and the modified antisense sequence, and hybridizing the sense and antisense strands to form the iRNA agent.

36. The iRNA agent of claim 1, wherein the sense strand has 4 asymmetrical 2'-O-alkyl modifications at the 4 terminal nucleotides of the 5' end, and at least one 2'-O-alkyl modification in another portion of the sense strand.

37. The iRNA agent of claim 8, wherein the sense strand has 4 asymmetrical 2'-O-alkyl modifications at the 4 terminal nucleotides of the 3' end, and at least one 2'-O-alkyl modification in another portion of the sense strand.

38. The iRNA agent of claim 1, wherein antisense strand does not contain any 2'-O-alkyl modifications, and the sense strand does not contain any phosphorothioate modifications.

39. The iRNA agent of claim 8, wherein antisense strand does not contain any 2'-O-alkyl modifications, and the sense strand does not contain any phosphorothioate modifications.

* * * * *